US010729725B2

(12) United States Patent
Terrett et al.

(10) Patent No.: US 10,729,725 B2
(45) Date of Patent: Aug. 4, 2020

(54) MATERIALS AND METHODS FOR ENGINEERING CELLS AND USES THEREOF IN IMMUNO-ONCOLOGY

(71) Applicant: CRISPR Therapeutics AG, Zug (CH)

(72) Inventors: Jonathan Alexander Terrett, Cambridge, MA (US); Demetrios Kalaitzidis, Cambridge, MA (US); Lawrence Klein, Cambridge, MA (US)

(73) Assignee: CRISPR Therapeutics AG, Zug (CH)

( * ) Notice: Subject to any disclaimer, the term of this patent is extended or adjusted under 35 U.S.C. 154(b) by 0 days.

(21) Appl. No.: 16/435,173

(22) Filed: Jun. 7, 2019

(65) Prior Publication Data

US 2019/0314414 A1    Oct. 17, 2019

Related U.S. Application Data

(62) Division of application No. 15/977,798, filed on May 11, 2018, now abandoned.

(60) Provisional application No. 62/567,008, filed on Oct. 2, 2017, provisional application No. 62/508,862, filed on May 19, 2017, provisional application No. 62/567,012, filed on Oct. 2, 2017, provisional application No. 62/648,138, filed on Mar. 26, 2018, provisional application No. 62/655,510, filed on Apr. 10, 2018, provisional application No. 62/538,138, filed on Jul. 28, 2017, provisional application No. 62/583,793, filed on Nov. 9, 2017, provisional application No. 62/639,332, filed on Mar. 6, 2018, provisional application No. 62/505,649, filed on May 12, 2017.

(51) Int. Cl.
| | | |
|---|---|---|
| *A61K 35/17* | (2015.01) | |
| *C12N 15/62* | (2006.01) | |
| *C12N 15/63* | (2006.01) | |
| *A61K 39/00* | (2006.01) | |
| *C07K 14/705* | (2006.01) | |
| *C07K 14/725* | (2006.01) | |
| *C07K 14/74* | (2006.01) | |
| *C12N 15/10* | (2006.01) | |
| *C12N 15/90* | (2006.01) | |

(52) U.S. Cl.
CPC ...... *A61K 35/17* (2013.01); *A61K 39/001112* (2018.08); *A61K 39/001138* (2018.08); *C07K 14/7051* (2013.01); *C07K 14/70517* (2013.01); *C07K 14/70521* (2013.01); *C07K 14/70539* (2013.01); *C07K 14/70578* (2013.01); *C12N 15/102* (2013.01); *C12N 15/62* (2013.01); *C12N 15/63* (2013.01); *A61K 2039/5156* (2013.01); *A61K 2039/5158* (2013.01); *C07K 2319/02* (2013.01); *C07K 2319/03* (2013.01); *C07K 2319/33* (2013.01); *C12N 15/907* (2013.01)

(58) Field of Classification Search
CPC ............ A61K 35/17; A61K 39/001112; A61K 39/001138; A61K 2039/5158; A61K 2039/5156; C07K 14/70521; C07K 14/70539; C07K 14/7051; C07K 14/70517; C07K 14/70578; C07K 2319/03; C07K 2319/02; C07K 2319/33; C12N 15/102; C12N 15/63; C12N 15/62; C12N 15/907; C12Q 2521/301
USPC ...................... 424/93.21, 93.2, 184.1, 133.1; 435/320.1, 325, 328, 375, 455; 530/387.3; 536/23.4
See application file for complete search history.

(56) References Cited

U.S. PATENT DOCUMENTS

| | | | |
|---|---|---|---|
| 7,083,785 B2 | 8/2006 | Browning et al. | |
| 7,435,596 B2 | 10/2008 | Campana et al. | |
| 7,446,179 B2 | 11/2008 | Jensen et al. | |
| 7,446,190 B2 | 11/2008 | Sadelain et al. | |
| 7,452,981 B2 | 11/2008 | Wijdenes et al. | |
| 7,491,390 B2 | 2/2009 | Law et al. | |
| 7,641,903 B2 | 1/2010 | Law et al. | |
| 7,662,387 B2 | 2/2010 | Law et al. | |
| 7,700,739 B2 | 4/2010 | Lacy et al. | |
| 7,741,465 B1 | 6/2010 | Eshhar et al. | |
| 7,771,720 B2 | 8/2010 | Staunton et al. | |
| 7,888,121 B2 | 2/2011 | Urnov et al. | |
| 8,067,546 B2 | 11/2011 | McDonagh et al. | |
| 8,124,738 B2 | 2/2012 | Terret et al. | |
| 8,337,838 B2 | 12/2012 | Law et al. | |
| 8,440,806 B2 | 5/2013 | Wijdenes et al. | |
| 8,535,678 B2 | 9/2013 | Law et al. | |
| 8,562,987 B2 | 10/2013 | McDonagh et al. | |

(Continued)

FOREIGN PATENT DOCUMENTS

| | | |
|---|---|---|
| WO | 2004/073656 A2 | 9/2004 |
| WO | 2006/060878 A1 | 6/2006 |

(Continued)

OTHER PUBLICATIONS

Eyquem, J. et al.,"Targeting a CAR to the TRAC locus with CRISPR/Cas9 enhances tumour rejection", Nature, vol. 543 (7643):113-117(2017).

(Continued)

*Primary Examiner* — Janet L Epps-Smith
(74) *Attorney, Agent, or Firm* — Polsinelli PC

(57) ABSTRACT

Materials and methods for producing genome-edited cells engineered to express a chimeric antigen receptor (CAR) construct on the cell surface, and materials and methods for genome editing to modulate the expression, function, or activity of one or more immuno-oncology related genes in a cell, and materials and methods for treating a patient using the genome-edited engineered cells.

29 Claims, 103 Drawing Sheets

Specification includes a Sequence Listing.

(56) References Cited

U.S. PATENT DOCUMENTS

| | | |
|---|---|---|
| 8,609,104 B2 | 12/2013 | Law et al. |
| 8,629,257 B2 | 1/2014 | Lacy et al. |
| 8,647,624 B2 | 2/2014 | Law et al. |
| 8,663,642 B2 | 3/2014 | Law et al. |
| 8,673,304 B2 | 3/2014 | Wijdenes et al. |
| 8,834,882 B2 | 9/2014 | Silence et al. |
| 8,871,908 B2 | 10/2014 | Liu et al. |
| 8,956,828 B2 | 2/2015 | Bonini et al. |
| 9,023,999 B2 | 5/2015 | Mori et al. |
| 9,051,372 B2 | 6/2015 | Law et al. |
| 9,102,737 B2 | 8/2015 | Chen et al. |
| 9,120,854 B2 | 9/2015 | Ryan et al. |
| 9,169,325 B2 | 10/2015 | Keler et al. |
| 9,382,319 B2 | 7/2016 | Tso et al. |
| 9,399,074 B2 | 7/2016 | Liu et al. |
| 9,403,914 B2 | 8/2016 | Kubota |
| 9,428,585 B2 | 8/2016 | McDonagh et al. |
| 9,701,752 B2 | 7/2017 | McDonagh et al. |
| 9,758,581 B2 | 9/2017 | Wijdenes et al. |
| 9,765,148 B2 | 9/2017 | Silence et al. |
| 9,765,149 B2 | 9/2017 | Silence et al. |
| 9,889,160 B2 | 2/2018 | Jantz et al. |
| 9,937,207 B2 | 4/2018 | Gregory et al. |
| 2006/0051346 A1 | 3/2006 | Wijdenes |
| 2008/0138343 A1 | 6/2008 | Law et al. |
| 2009/0081239 A1 | 3/2009 | Staunton et al. |
| 2009/0148942 A1 | 6/2009 | McDonagh et al. |
| 2009/0208496 A1 | 8/2009 | Wijdenes et al. |
| 2010/0129362 A1 | 5/2010 | Law et al. |
| 2012/0034159 A1 | 2/2012 | Kindsvogel |
| 2012/0045436 A1 | 2/2012 | McDonagh et al. |
| 2012/0213771 A1 | 8/2012 | Keler et al. |
| 2012/0294863 A1 | 11/2012 | Law et al. |
| 2013/0039911 A1 | 2/2013 | Bedi et al. |
| 2013/0122020 A1 | 5/2013 | Liu et al. |
| 2013/0138586 A1 | 5/2013 | Jung et al. |
| 2013/0287748 A1 | 10/2013 | June et al. |
| 2014/0105915 A1 | 4/2014 | Algate et al. |
| 2014/0112942 A1 | 4/2014 | Van Eenennaam et al. |
| 2014/0178936 A1 | 6/2014 | McDonagh et al. |
| 2014/0220008 A1 | 8/2014 | Wijdenes et al. |
| 2014/0349402 A1 | 11/2014 | Cooper et al. |
| 2014/0357844 A1 | 12/2014 | Liu et al. |
| 2015/0176013 A1 | 6/2015 | Musunuru et al. |
| 2015/0266963 A1 | 9/2015 | Silence et al. |
| 2015/0284467 A1 | 10/2015 | Lipp et al. |
| 2015/0337047 A1 | 11/2015 | Keler et al. |
| 2015/0368351 A1 | 12/2015 | Vu et al. |
| 2016/0046724 A1 | 2/2016 | Brogdon et al. |
| 2016/0289675 A1 | 10/2016 | Ryan et al. |
| 2017/0022282 A1 | 1/2017 | McDonagh et al. |
| 2017/0157176 A1 | 6/2017 | Wang et al. |
| 2017/0173080 A1 | 6/2017 | Lee et al. |
| 2017/0183418 A1 | 6/2017 | Galletto |
| 2017/0226216 A1 | 8/2017 | Morgan et al. |
| 2017/0233484 A1 | 8/2017 | Sussman et al. |
| 2017/0267771 A1 | 9/2017 | Van Eenennaam et al. |
| 2017/0281766 A1 | 10/2017 | Wiltzius |
| 2017/0313759 A1 | 11/2017 | Batuwangala |
| 2017/0320957 A1 | 11/2017 | Chen et al. |
| 2017/0335281 A1 | 11/2017 | Loew et al. |
| 2017/0335331 A1* | 11/2017 | Zhao ................. C12N 15/1138 |
| 2017/0342157 A1 | 11/2017 | McDonagh et al. |
| 2017/0355776 A1 | 12/2017 | Xiao et al. |
| 2017/0362297 A1 | 12/2017 | Marasco |
| 2017/0369581 A9 | 12/2017 | Silence et al. |
| 2018/0002435 A1 | 1/2018 | Sasu et al. |
| 2018/0051292 A1* | 2/2018 | Kochenderfer .... C07K 14/7051 |
| 2018/0186878 A1 | 7/2018 | Rosenthal |
| 2018/0325955 A1 | 11/2018 | Terrett et al. |

FOREIGN PATENT DOCUMENTS

| | | |
|---|---|---|
| WO | 2006/113909 A2 | 10/2006 |
| WO | 2008/121420 A1 | 10/2008 |
| WO | 2011/059836 A2 | 5/2011 |
| WO | 2011/130434 A2 | 10/2011 |
| WO | 2012/004367 A1 | 1/2012 |
| WO | 2012058460 A2 | 5/2012 |
| WO | 2012/079000 A1 | 6/2012 |
| WO | 2013/074916 A1 | 5/2013 |
| WO | 2013/138586 A1 | 9/2013 |
| WO | 2013/154760 A1 | 10/2013 |
| WO | 2013/176915 A1 | 11/2013 |
| WO | 2014/068079 A1 | 5/2014 |
| WO | 2014/122143 A1 | 8/2014 |
| WO | 2014/140374 A2 | 9/2014 |
| WO | 2014/158821 A1 | 10/2014 |
| WO | 2014/165119 A1 | 10/2014 |
| WO | 2014/165825 A2 | 10/2014 |
| WO | 2014/191128 A1 | 12/2014 |
| WO | 2015/120096 A2 | 8/2015 |
| WO | 2015/121454 A1 | 8/2015 |
| WO | 2015/136001 A1 | 9/2015 |
| WO | 2015/161276 A2 | 10/2015 |
| WO | 2015/164594 A1 | 10/2015 |
| WO | 2015/187528 A1 | 12/2015 |
| WO | 2015/188056 A1 | 12/2015 |
| WO | 2016/014789 A2 | 1/2016 |
| WO | 2016/025454 A2 | 2/2016 |
| WO | 2016/063264 A1 | 4/2016 |
| WO | 2016/069282 A1 | 5/2016 |
| WO | 2016/069283 A1 | 5/2016 |
| WO | 2016/073955 A2 | 5/2016 |
| WO | 2016/090320 A1 | 6/2016 |
| WO | 2016/094304 A2 | 6/2016 |
| WO | 2016/100985 A2 | 6/2016 |
| WO | 2016/120216 A1 | 8/2016 |
| WO | 2016/151315 A1 | 9/2016 |
| WO | 2016/160721 A1 | 10/2016 |
| WO | 2016/164356 A1 | 10/2016 |
| WO | 2016/174652 A1 | 11/2016 |
| WO | 2016/183041 A2 | 11/2016 |
| WO | 2017/058850 A1 | 4/2017 |
| WO | 2017/062451 A1 | 4/2017 |
| WO | 2017/070429 A1 | 4/2017 |
| WO | 2017/075537 A1 | 5/2017 |
| WO | 2017/083511 A1 | 5/2017 |
| WO | 2017/093969 A1 | 6/2017 |
| WO | 2017/100176 A1 | 6/2017 |
| WO | 2017/106528 A2 | 6/2017 |
| WO | 2017/112859 A1 | 6/2017 |
| WO | 2017/130223 A2 | 8/2017 |
| WO | 2017/143069 A1 | 8/2017 |
| WO | 2017/149515 A1 | 9/2017 |
| WO | 2017/156484 A1 | 9/2017 |
| WO | 2017/177137 A1 | 10/2017 |
| WO | 2017/180993 A1 | 10/2017 |
| WO | 2017/186928 A1 | 11/2017 |
| WO | 2017/189959 A1 | 11/2017 |
| WO | 2017/210617 A2 | 12/2017 |
| WO | 2017/211900 A1 | 12/2017 |
| WO | 2017/222593 A1 | 12/2017 |
| WO | 2018/068257 A1 | 4/2018 |
| WO | 2018/073391 A1 | 4/2018 |
| WO | 2018/073393 A2 | 4/2018 |
| WO | 2018/132479 A1 | 7/2018 |

OTHER PUBLICATIONS

Fraietta, J. et al., "Determinants of response and resistance to CD19 chimeric antigen receptor (CAR) T cell therapy of chronic lymphocytic leukemia", Nature Medicine, vol. 24(5):563-571 (2018).
International Search Report and Written Opinion, PCT/IB2018/001619, dated Jul. 3, 2019, 18 pages.
Invitation to Pay Additional Fees and, Where Applicable, Protest Fee, PCT/IB2018/001619, dated May 10, 2019, 16 pages.
Jaspers J., et al., "Development of CAR T cells designed to improve antitumor efficacy and safety," Pharmacology and Therapeutics, vol. 178:83-91 (2017).
Liu, X. et al., "CRISPR-Cas9-mediated multiplex gene editing in CAR-T cells", Cell Research, vol. 27(1):154-157 (2016).

(56) References Cited

OTHER PUBLICATIONS

Macleod, D. et al. "Integration of a CD19 CAR into the TCR alpha chain locus streamlines production of allogeneic gene-edited CAR T cells", Molecular Therapy, vol. 25(4):949-961 (2017).

Maude, S. et al., "Chimeric antigen receptor T cells for sustained remissions in leukemia", The New England Journal of Medicine, vol. 371:1507-1517 (2014).

Osborn, M. et al., "Evaluation of TCR gene editing achieved by TALENs, CRISPR/Cas9, and megaTAL nucleases", Molecular Therapy, vol. 24(3):570-581 (2016).

Poirot, L. et al., "Multiplex genome-edited T-cell manufacturing platform for "off-the-shelf" adoptive T-cell immunotherapies", Cancer Research, vol. 75(18):3853-3864 (2015).

Ren J. et al., "Advancing chimeric antigen receptor T cell therapy with CRISPR/Cas9", Protein & Cell, vol. 8 (9):634-643 (2017).

Ren, J. et al. "A versatile system for rapid multiplex genome-edited CAR T cell generation", Oncotarget, vol. 8 (10):17002-17011 (2017).

Ren, J. et al., "Multiplex Genome Editing to Generate Universal CAR T Cells Resistant to PD1 Inhibition," Clinical Cancer Research, vol. 23 (9):2255-2266 (2016).

Torikai, H. et al., "A foundation for universal T-cell based immunotherapy: T cells engineered to express a CD19-specific chimeric-antigen-receptor and eliminate expression of endogenous TCR", Blood, vol. 119(24):5697-5705 (2012).

U.S. Appl. No. 15/977,798, filed May 11, 2018, Jonathan Alexander Terrett.

U.S. Appl. No. 16/431,475, filed Jun. 4, 2019, Jonathan Alexander Terrett.

U.S. Appl. No. 16/434,079, filed Jun. 6, 2019, Jonathan Alexander Terrett.

U.S. Appl. No. 16/435,146, filed Jun. 7, 2019, Jonathan Alexander Terrett.

U.S. Appl. No. 16/409,737, filed May 10, 2019, Jonathan Alexander Terrett.

U.S. Appl. No. 15/977,798, dated Nov. 8, 2018.

* cited by examiner

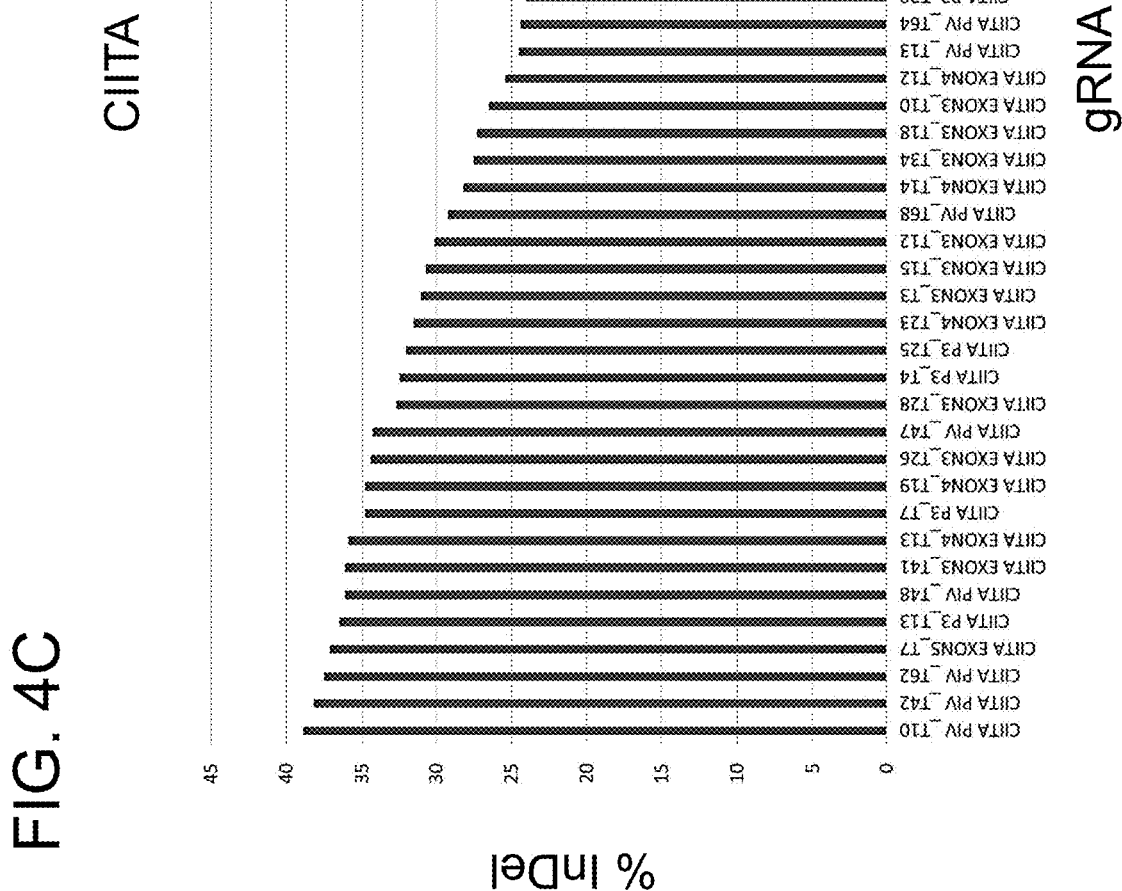

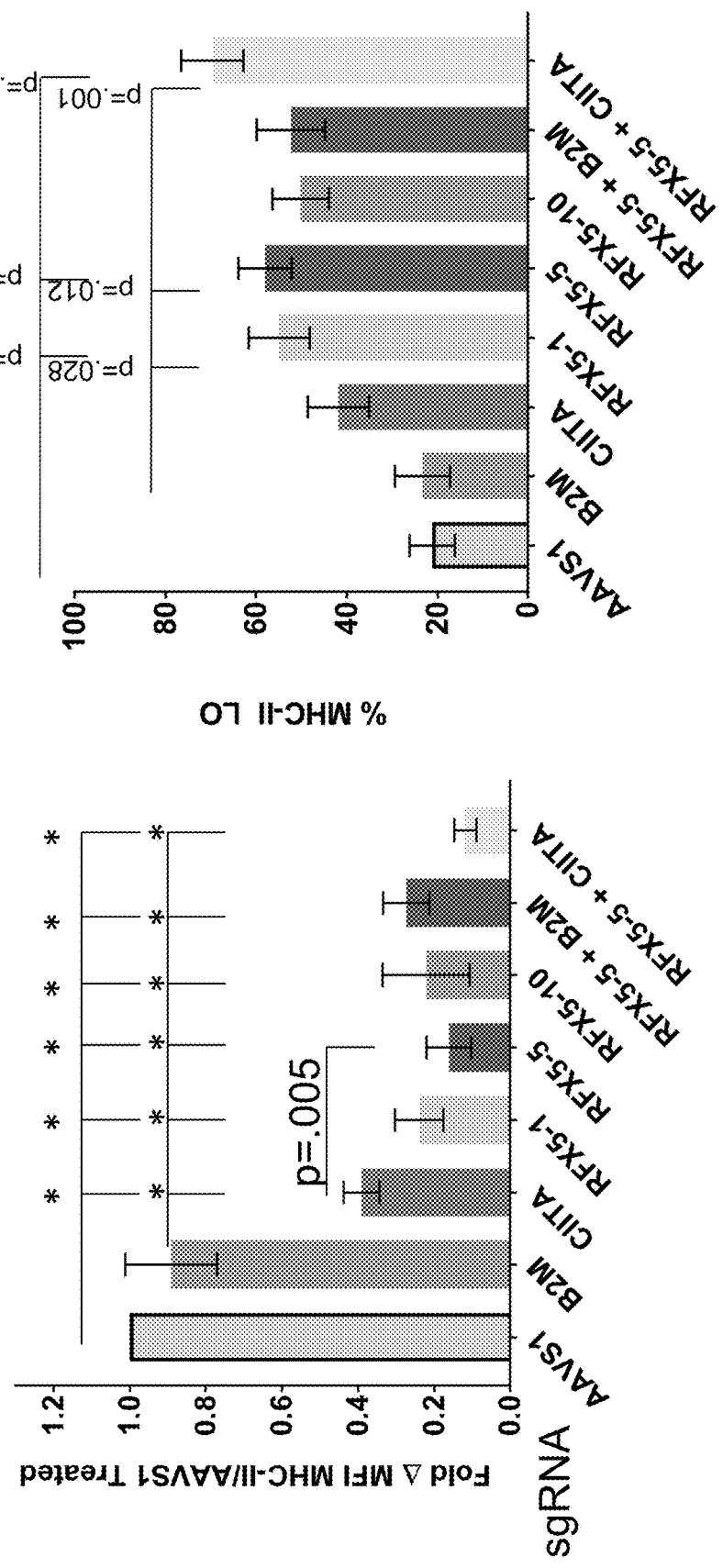
FIG. 7 Cas9:sgRNAs Targeting RFX5 Can Reduce MHC-II Surface Expression in T Cells
n = 4 donors for single RNP treated cells
n = 3 donors for double RNP treated cells
* = p <.0001, ANOVA with post hoc Tukey DNA Evidence of HDR 14 Days Post Manipulation in Primary Human T cells FIG. 11 HDR in Single or Double Knockout cells (at Day 7)

High HDR Efficiency and Low Variability Among Donors

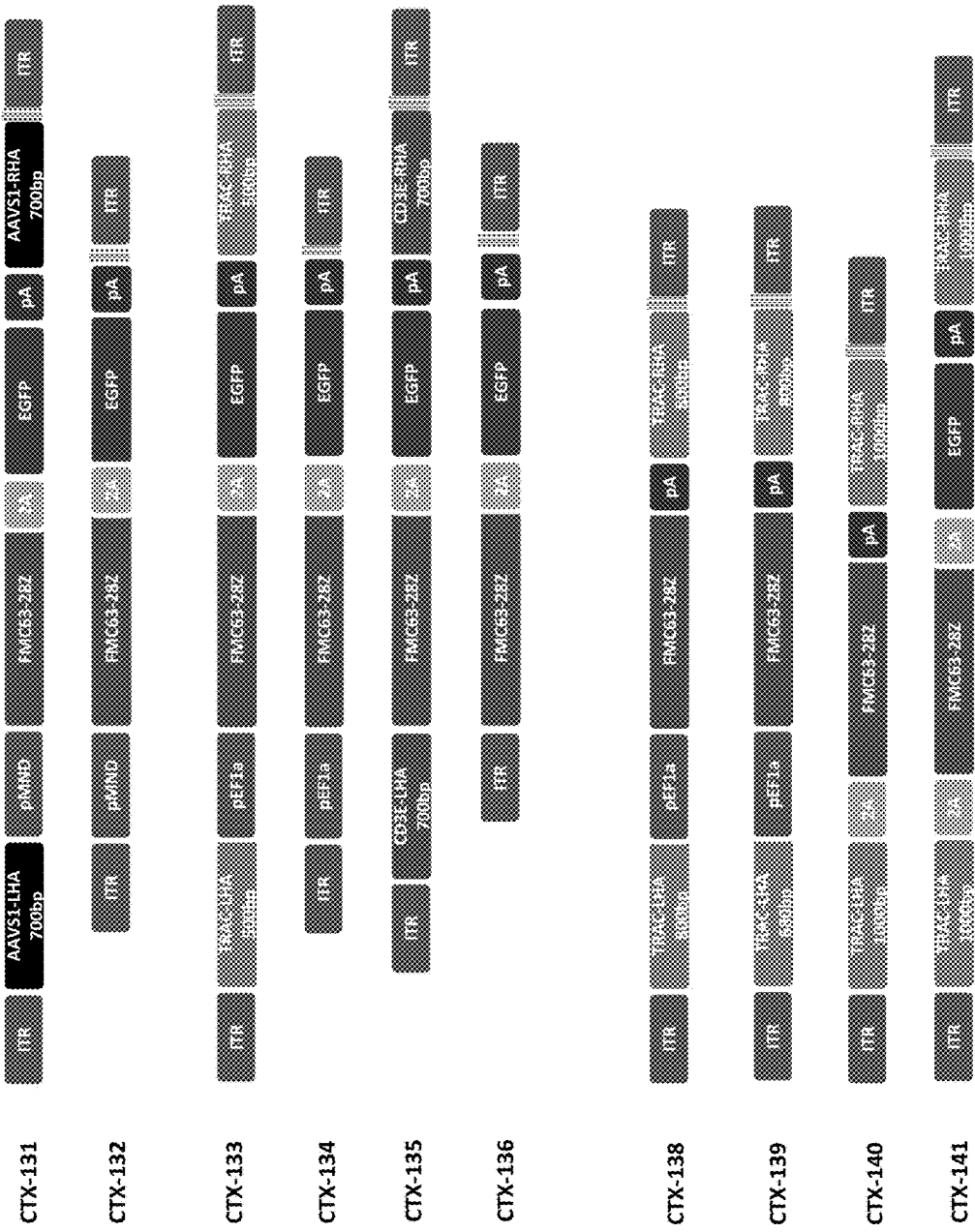

Persistent Splenic TC1 CD8+ Cells Are Edited
(Disseminated Model)

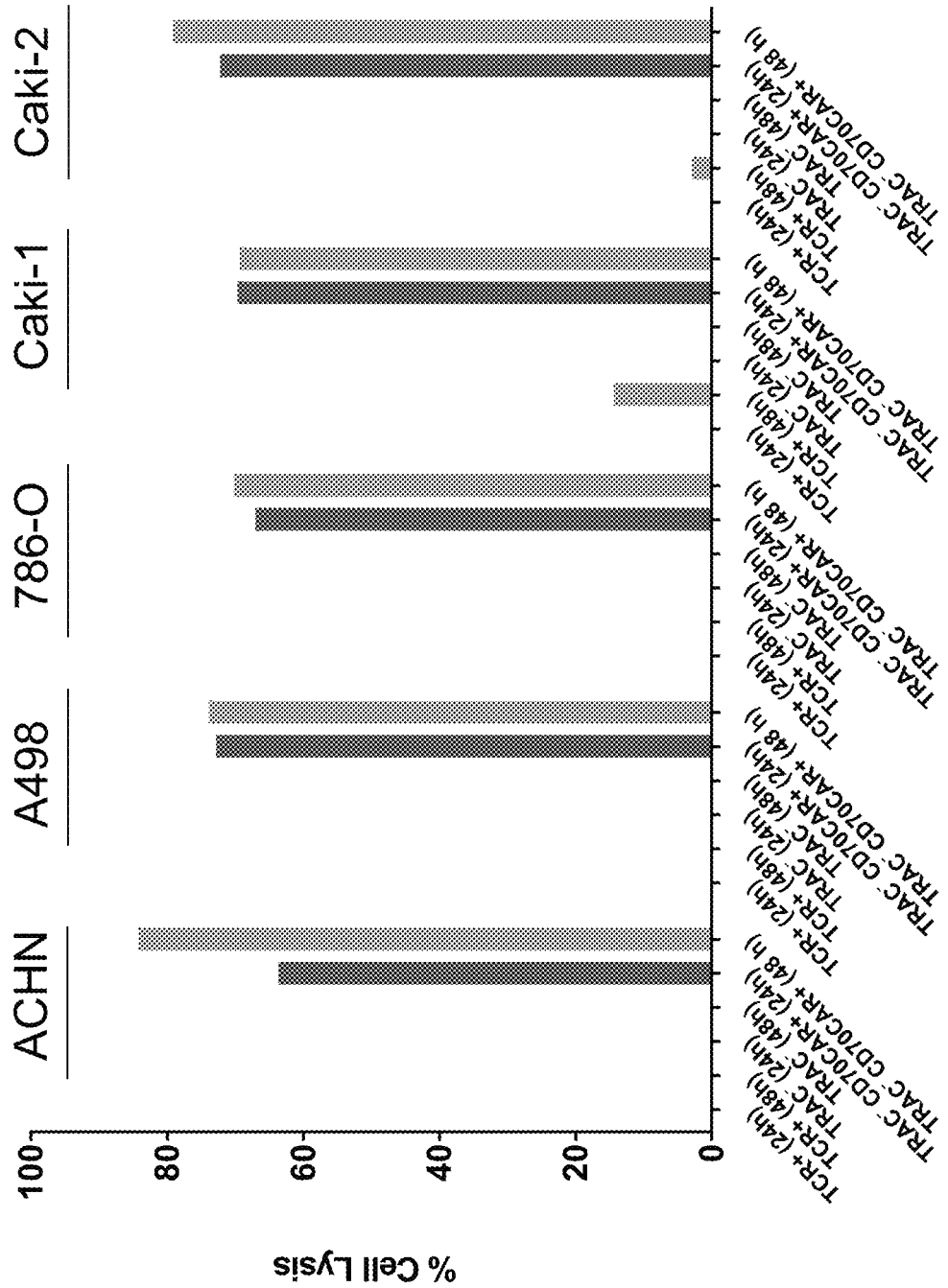

FIG. 32
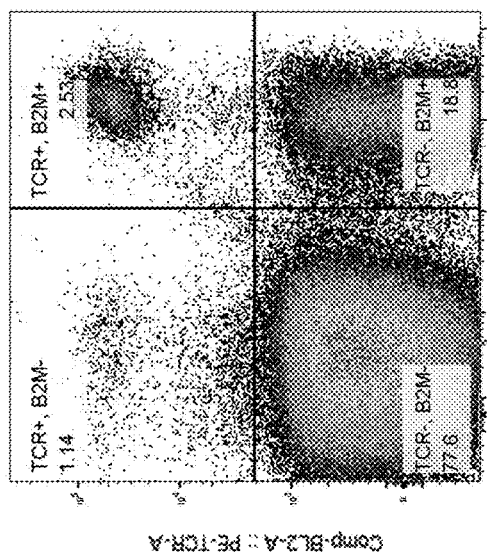
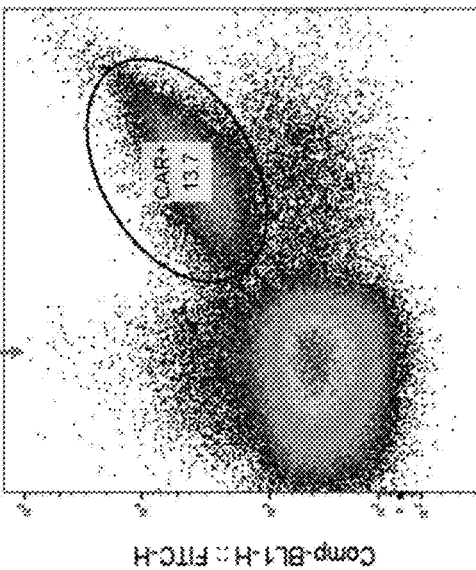
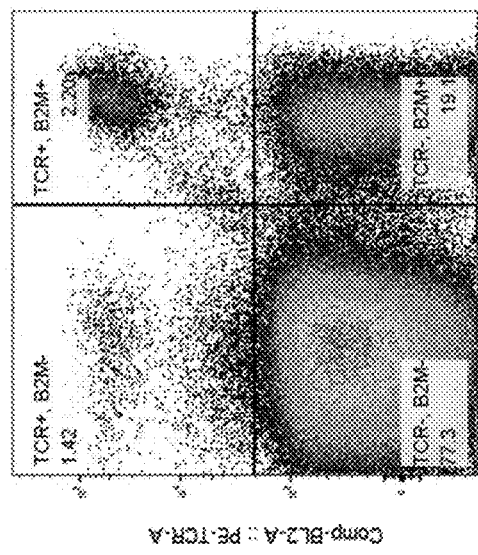
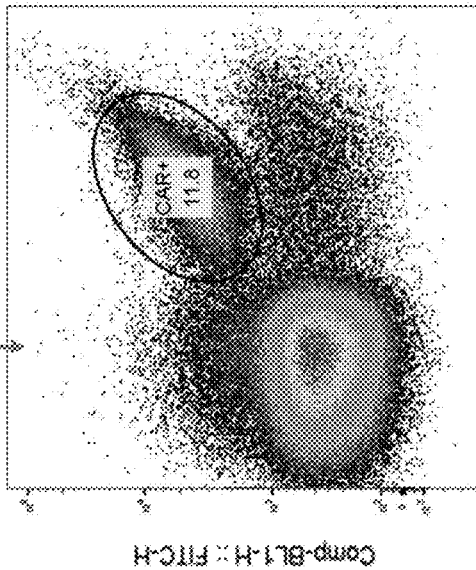

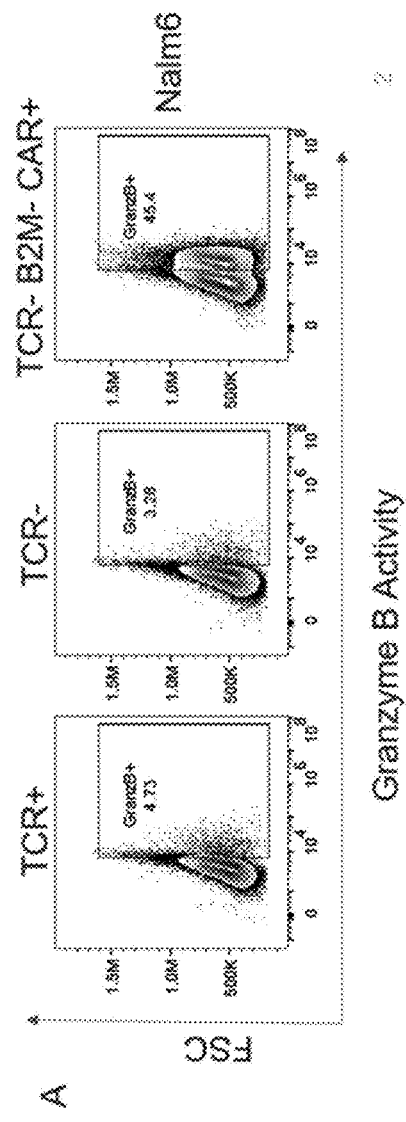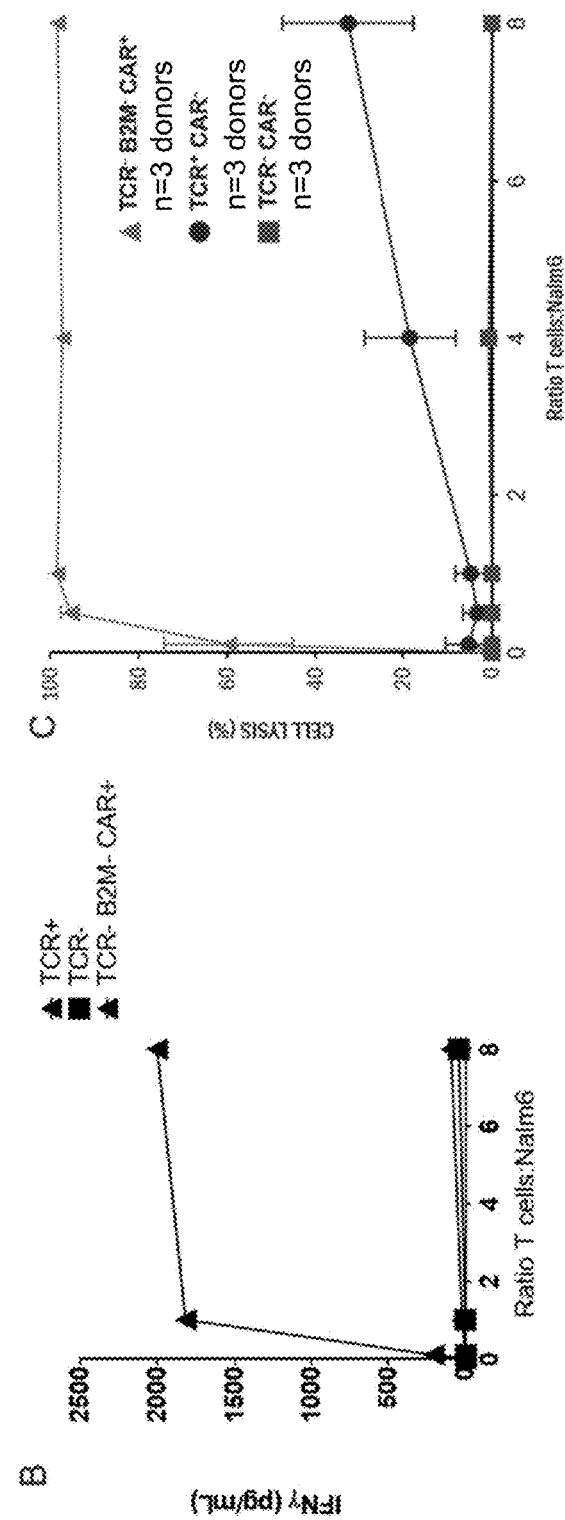
FIG. 35A  FIG. 35B  FIG. 35C

FIG. 50
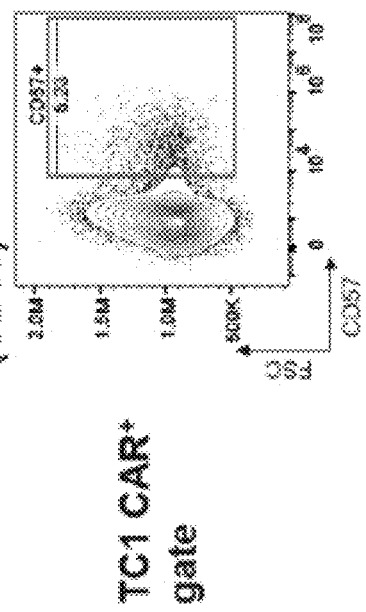
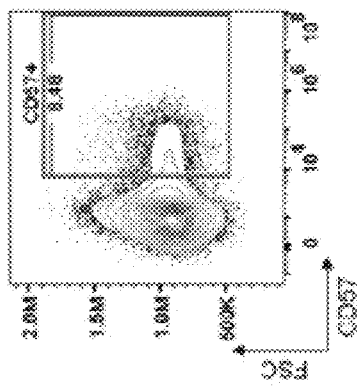
LOW SENESCENCE MARKER (CD57)
TC1 CAR+ gate
TC1 CAR- gate
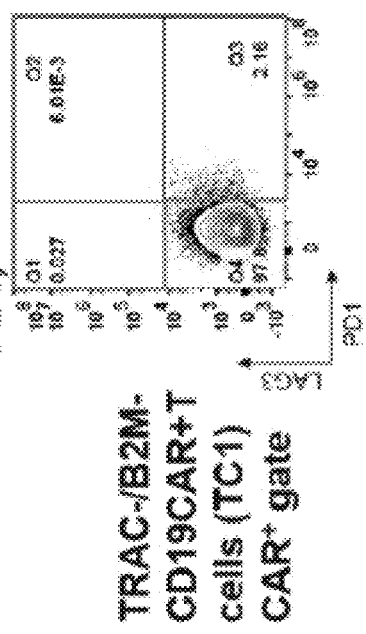
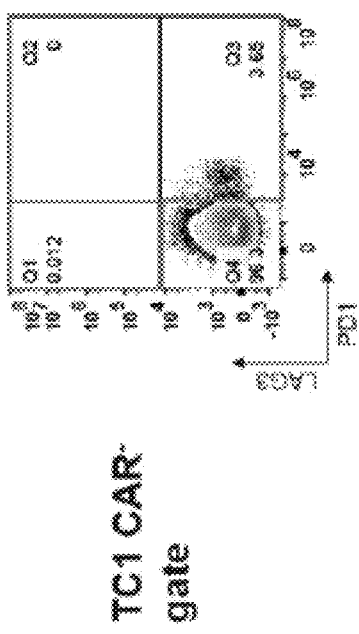
LOW EXHAUSTION MARKERS (LAG3 AND PD1)
TRAC-/B2M-CD19CAR+ T cells (TC1) CAR+ gate
TC1 CAR- gate

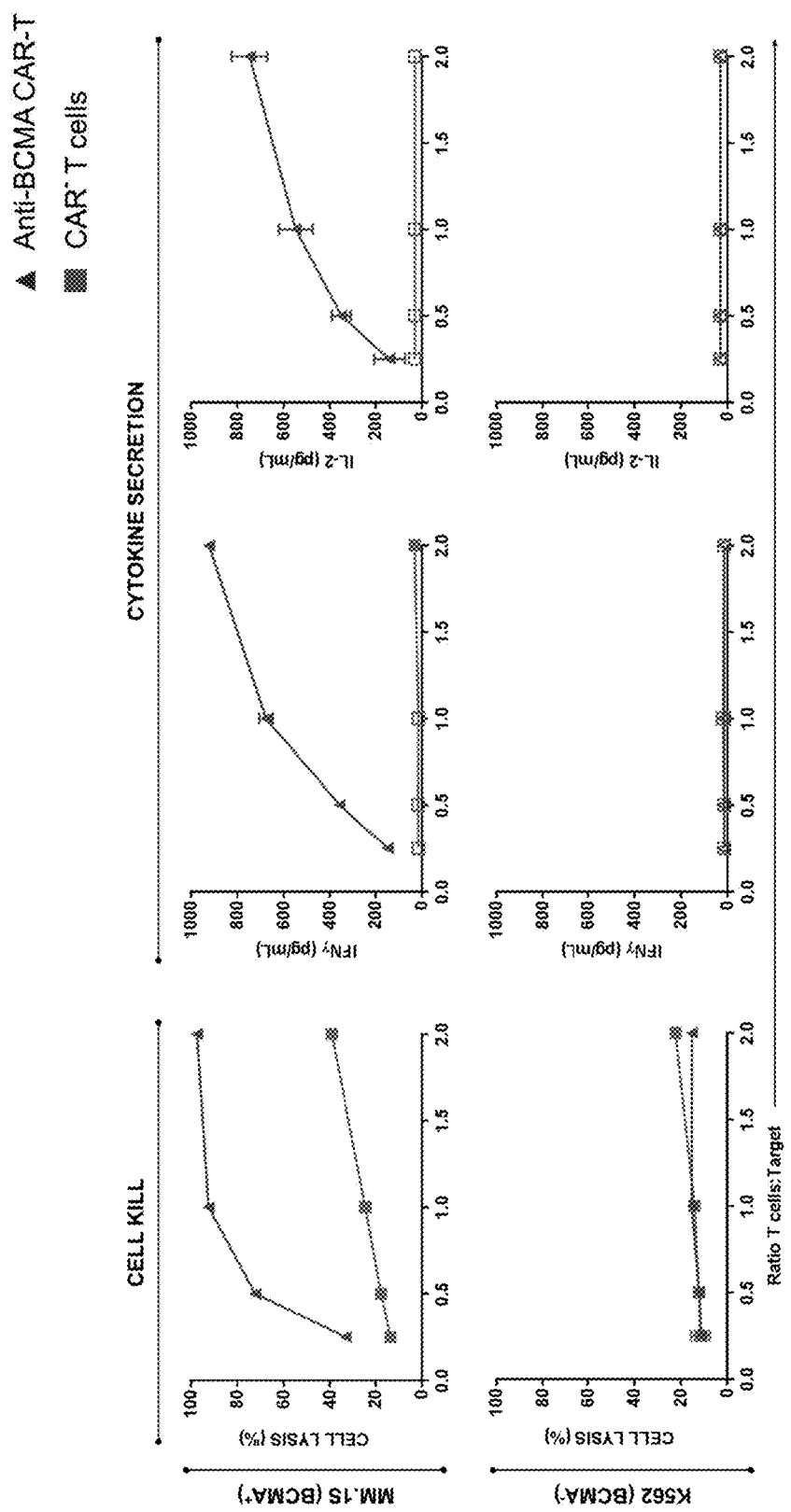

MATERIALS AND METHODS FOR ENGINEERING CELLS AND USES THEREOF IN IMMUNO-ONCOLOGY

RELATED APPLICATIONS

This application is a divisional of application Ser. No. 15/977,798, filed May 11, 2018 and which claims the benefit under 35 U.S.C. § 119(e) of U.S. provisional application No. 62/505,649, filed May 12, 2017, U.S. provisional application No. 62/508,862, filed May 19, 2017, U.S. provisional application No. 62/538,138, filed Jul. 28, 2017, U.S. provisional application No. 62/567,012, filed Oct. 2, 2017, U.S. provisional application No. 62/567,008, filed Oct. 2, 2017, U.S. provisional application No. 62/583,793, filed Nov. 9, 2017, U.S. provisional application No. 62/639,332, filed Mar. 6, 2018, U.S. provisional application No. 62/648,138, filed Mar. 26, 2018, and U.S. provisional application No. 62/655,510, filed on Apr. 10, 2018, each of which is incorporated by reference herein in its entirety.

FIELD

In some aspects, the present application provides materials and methods for producing genome-edited cells engineered to express a chimeric antigen receptor (CAR) construct on the cell surface. In other aspects, the present application provides materials and methods for genome editing to modulate the expression, function, or activity of one or more immuno-oncology related genes in a cell. In yet other aspects, the present application provides materials and methods for treating a patient using the genome-edited engineered cells, both ex vivo and in vivo.

INCORPORATION BY REFERENCE OF SEQUENCE LISTING

The instant application contains a Sequence Listing which has been submitted in ASCII format via EFS-Web and is hereby incorporated by reference in its entirety. Said ASCII copy, created on Jun. 6, 2019, is named SeqListing_CRTN_098DV3 and is 1251365 bytes in size. The Sequence Listing is being submitted by EFS Web and is hereby incorporated by reference into the specification.

BACKGROUND

Genome engineering refers to strategies and techniques for the targeted, specific modification of the genetic information (genome) of living organisms. Genome engineering is an active field of research because of the wide range of possible applications, particularly in the area of human health, e.g., to correct a gene carrying a harmful mutation or to explore the function of a gene. Early technologies developed to insert a transgene into a living cell were often limited by the random nature of the insertion location of the new sequence into the genome. Random insertions into the genome may result in disruption of normal regulation of neighboring genes leading to severe unintended effects. Furthermore, random integration technologies offer little reproducibility, as there is no guarantee that the sequence would be inserted at the same place in two different cells. Common genome engineering strategies, such as ZFNs, TALENs, HEs, and MegaTALs, allow a specific area of the DNA to be modified, thereby increasing precision of the correction or insertion compared to earlier technologies. These platforms offer a greater degree of reproducibility, but limitations remain.

Despite efforts from researchers and medical professionals worldwide to address genetic disorders, and despite the promise of previous genome engineering approaches, there remains a long-felt need to develop safe and effective universal donor cells in support of cell therapy treatments involving regenerative medicine and/or immuno-oncology related indications.

SUMMARY

Provided herein, in some embodiments, are cells, methods, and compositions (e.g., nucleic acids, vectors, pharmaceutical compositions) used for the treatment of certain malignancies. The gene editing technology of the present disclosure, in some aspects, is used to engineer immune cell therapies targeting tumor cells that express the CD19, CD70, or BCMA antigens. Surprisingly, the immune cell therapies engineered according to the methods of the present disclosure are capable of reducing tumor volume in vivo, in some embodiments, by at least 80%, relative to untreated controls. Data from animal models, as provided herein, demonstrates that the engineered immune cell therapies, in some embodiments, eliminate the presence of detectable tumor cells just 30 days following in vivo administration, and the effect in these animal models, following a single dose of the cell therapy, persists for at least 66 days. Further, in some embodiments, the engineered immune cell therapies of the present disclosure are capable of increasing the survival rate of subject by at least 50% relative to untreated controls.

Further still, these cells are engineered to block both host-versus-graft disease and graft-versus-host disease, which renders them suitable for use as allogeneic cell transplantation therapeutics.

Moreover, genetic constructs and methods provided herein may be used, in some embodiments, to engineer immune cell populations with gene modification efficiencies high enough that the cell populations do not require purification or enrichment prior to administration in vivo. For example, at least 80% of the immune cells of an exemplary engineered cell population of the present disclosure lack surface expression of both the T cell receptor alpha constant gene and the β2 microglobulin gene, and at least 50% of the immune cells also express the particular chimeric antigen receptor of interest (e.g., targeting CD19, CD70, or BCMA).

Thus, provided herein, in some aspects, are populations of cells comprising engineered T cells that comprise a T cell receptor alpha chain constant region (TRAC) gene disrupted by insertion of a nucleic acid encoding a chimeric antigen receptor (CAR) comprising (i) an ectodomain that comprises an anti-CD19 antibody fragment, (ii) a CD8 transmembrane domain, and (iii) an endodomain that comprises a CD28 or 41BB co-stimulatory domain and optionally a CD3z co-stimulatory domain, and a disrupted beta-2-microglobulin (B2M) gene, wherein at least 70% of the engineered T cells do not express a detectable level of TCR surface protein and do not express a detectable level of B2M surface protein, and/or wherein at least 50% of the engineered T cells express a detectable level of the CAR.

Other aspects provide populations of cells comprising engineered T cells that comprise a TRAC gene disrupted by insertion of a nucleic acid encoding a CAR comprising (i) an ectodomain that comprises an anti-CD70 antibody fragment, (ii) a CD8 transmembrane domain, and (iii) an endodomain that comprises a CD28 or 41BB co-stimulatory domain and optionally a CD3z co-stimulatory domain, and a disrupted B2M gene, wherein at least 70% of the engineered T cells do not express a detectable level of TCR surface protein and do not express a detectable level of B2M surface protein, and/or wherein at least 50% of the engineered T cells express a detectable level of the CAR.

Yet other aspects provide populations of cells comprising engineered T cells that comprise a TRAC gene disrupted by insertion of a nucleic acid encoding a CAR comprising (i) an ectodomain that comprises an anti-BCMA antibody fragment, (ii) a CD8 transmembrane domain, and (iii) an endodomain that comprises a CD28 or 41BB co-stimulatory domain and optionally a CD3z co-stimulatory domain, and a disrupted B2M gene, wherein at least 70% of the engineered T cells do not express a detectable level of TCR surface protein and do not express a detectable level of B2M surface protein, and/or wherein at least 50% of the engineered T cells express a detectable level of the CAR.

Some aspects of the present disclosure provide methods for producing an engineered T cell suitable for allogenic transplantation, the method comprising (a) delivering to a composition comprising a T cell a RNA-guided nuclease, a gRNA targeting a TRAC gene, a gRNA targeting a B2M gene, and a vector comprising a donor template that comprises a nucleic acid encoding a CAR, wherein the CAR comprises (i) an ectodomain that comprises an anti-CD19 antibody fragment, (ii) a CD8 transmembrane domain, and (iii) an endodomain that comprises a CD28 or 41BB co-stimulatory domain and optionally a CD3z co-stimulatory domain, wherein the nucleic acid encoding the CAR is flanked by left and right homology arms to the TRAC gene locus and (b) producing an engineered T cell suitable for allogeneic transplantation.

Other aspects of the present disclosure provide methods for producing an engineered T cell suitable for allogenic transplantation, the method comprising (a) delivering to a composition comprising a T cell a RNA-guided nuclease, a gRNA targeting a TRAC gene, a gRNA targeting a B2M gene, and a vector comprising a donor template that comprises a nucleic acid encoding a CAR, wherein the CAR comprises (i) an ectodomain that comprises an anti-CD70 antibody fragment, (ii) a CD8 transmembrane domain, and (iii) an endodomain that comprises a CD28 or 41BB co-stimulatory domain and optionally a CD3z co-stimulatory domain, wherein the nucleic acid encoding the CAR is flanked by left and right homology arms to the TRAC gene locus and (b) producing an engineered T cell suitable for allogeneic transplantation.

Yet other aspects of the present disclosure provide methods for producing an engineered T cell suitable for allogeneic transplantation, the method comprising (a) delivering to a composition comprising a T cell a RNA-guided nuclease, a gRNA targeting a TRAC gene, a gRNA targeting a B2M gene, and a vector comprising a donor template that comprises a nucleic acid encoding a CAR, wherein the CAR comprises (i) an ectodomain that comprises an anti-BCMA antibody fragment, (ii) a CD8 transmembrane domain, and (iii) an endodomain that comprises a CD28 or 41BB co-stimulatory domain and optionally a CD3z co-stimulatory domain, wherein the nucleic acid encoding the CAR is flanked by left and right homology arms to the TRAC gene locus and (b) producing an engineered T cell suitable for allogeneic transplantation.

In some embodiments, the engineered T cells are unpurified and/or unenriched. In some embodiments, the population of cells is unpurified and/or unenriched.

In some embodiments, the anti-CD19 antibody fragment is an anti-CD19 scFv antibody fragment. In some embodiments, the anti-CD70 antibody fragment is an anti-CD70 scFv antibody fragment. In some embodiments, the anti-BCMA antibody fragment is an anti-BCMA scFv antibody fragment.

In some embodiments, the antibody fragment (e.g., scFv fragment) is humanized. In some embodiments, the humanized anti-CD19 antibody fragment is encoded by the nucleotide sequence of SEQ ID NO: 1333 and/or wherein the humanized anti-CD19 antibody fragment comprises the amino acid sequence of SEQ ID NO: 1334. In some embodiments, the humanized anti-CD19 antibody fragment comprises a heavy chain that comprises the amino acid sequence of SEQ ID NO: 1595. In some embodiments, the humanized anti-CD19 antibody fragment comprises a light chain that comprises the amino acid sequence of SEQ ID NO: 1596. In some embodiments, the humanized anti-CD70 antibody fragment is encoded by the nucleotide sequence of SEQ ID NO: 1475 or 1476 and/or wherein the humanized anti-CD70 antibody fragment comprises the amino acid sequence of SEQ ID NO: 1499 or 1500. In some embodiments, the humanized anti-CD70 antibody fragment comprises a heavy chain that comprises the amino acid sequence of SEQ ID NO: 1592. In some embodiments, the humanized anti-CD70 antibody fragment comprises a light chain that comprises the amino acid sequence of SEQ ID NO: 1593. In some embodiments, the humanized anti-BCMA antibody fragment is encoded by the nucleotide sequence of SEQ ID NO: 1479 or 1485 the humanized anti-BCMA antibody fragment comprises the amino acid sequence of SEQ ID NO: 1503 or 1509. In some embodiments, the humanized anti-BCMA antibody fragment comprises a heavy chain that comprises the amino acid sequence of SEQ ID NO: 1589 or 1524. In some embodiments, the humanized anti-BCMA antibody fragment comprises a light chain that comprises the amino acid sequence of SEQ ID NO: 1590 or 1526.

In some embodiments, the ectodomain of the CAR further comprises a signal peptide, optionally a CD8 signal peptide. In some embodiments, the CAR further comprises a hinge domain, optionally a CD8 hinge domain, located between the anti-CD19 antibody fragment and the CD8 transmembrane domain. In some embodiments, the CAR comprises the following structural arrangement from N-terminus to C-terminus: the ectodomain that comprises an anti-CD19 antibody fragment, a CD8 hinge domain, the CD8 transmembrane domain, and the endodomain that comprises a CD28 or 41BB co-stimulatory domain and a CD3z co-stimulatory domain.

In some embodiments, the CAR (anti-CD19 CAR) is encoded by the nucleotide sequence of SEQ ID NO: 1316 and/or wherein the CAR comprises the amino acid sequence of SEQ ID NO: 1338. In some embodiments, the CAR (anti-CD70 CAR) is encoded by the nucleotide sequence of SEQ ID NO: 1423, 1424, or 1275, and/or wherein the CAR comprises the amino acid sequence of SEQ ID NO: 1449, 1450, or 1276. In some embodiments, the CAR (anti-BCMA CAR) is encoded by the nucleotide sequence of SEQ ID NO: 1427, 1428, 1434, or 1435, and/or wherein the CAR comprises the amino acid sequence of SEQ ID NO: 1453, 1454, 1460, or 1461.

In some embodiments, at least 70% (e.g., at least 75%, at least 80%, at least 85%, at least 90%, or at least 95%) of the engineered T cells do not express a detectable level of TCR and/or B2M surface protein.

In some embodiments, at least 50% (e.g., at least 55%, at least 60%, at least 65%, at least 70%, or at least 75%) of the engineered T cells express a detectable level of the CAR.

In some embodiments, at least 50% (e.g., at least 55%, at least 60%, at least 65%, at least 70%, at least 75%, or at least 80%) of the engineered T cells express a detectable level of the CAR and do not express a detectable level of TCR surface protein or B2M surface protein (e.g., detectable by flow cytometry.

In some embodiments, co-culture of the engineered T cell with CD19+ B cells results in lysis of at least 50% (e.g., at least 55%, at least 60%, at least 65%, at least 70%, or at least 75%) of the CD19+ B cells. In some embodiments, co-culture of the engineered T cell with CD70+ B cells results in lysis of at least 50% (e.g., at least 55%, at least 60%, at least 65%, at least 70%, or at least 75%) of the CD70+ B cells. In some embodiments, co-culture of the engineered T cell with BCMA+ B cells results in lysis of at least 50% (e.g., at least 55%, at least 60%, at least 65%, at least 70%, or at least 75%) of the BCMA+ B cells.

In some embodiments, the engineered T cells produce interferon gamma in the presence of CD19+ cells. In some embodiments, the engineered T cells produce interferon gamma in the presence of CD70+ cells. In some embodiments, the engineered T cells produce interferon gamma in the presence of BCMA+ cells.

In some embodiments, the engineered T cells do not proliferate in the absence of cytokine stimulation, growth factor stimulation, or antigen stimulation.

In some embodiments, the population of cells further comprises a disrupted programmed cell death protein 1 (PD1) gene. In some embodiments, at least 70% (e.g., at least 75%, at least 80%, at least 85%, or at least 90%) of the engineered T cells do not express a detectable level of PD1 surface protein.

In some embodiments, the population of cells further comprises a disrupted cytotoxic T-lymphocyte-associated protein 4 (CTLA-4) gene. In some embodiments, at least 70% (e.g., at least 75%, at least 80%, at least 85%, or at least 90%) of the engineered T cells do not express a detectable level of CTLA-4 surface protein.

In some embodiments, the population of cells further comprises a gRNA targeting the TRAC gene, a gRNA targeting the B2M gene, and Cas9 protein (e.g., a *S. pyogenes* Cas9 protein).

In some embodiments, the gRNA targeting the TRAC gene comprises the nucleotide sequence of any one of SEQ ID NOs: 83-158. In some embodiments, the gRNA targeting the TRAC gene targets the nucleotide sequence of any one of SEQ ID NOs: 7-82. In some embodiments, the gRNA targeting the B2M gene comprises the nucleotide sequence of any one SEQ ID NOs: 458-506. In some embodiments, the gRNA targeting the B2M gene targets the nucleotide sequence of any one of SEQ ID NOs: 409-457. In some embodiments, the gRNA targeting the TRAC gene comprises the nucleotide sequence of SEQ ID NO: 152. In some embodiments, the gRNA targeting the TRAC gene targets the nucleotide sequence of SEQ ID NO: 76. In some embodiments, the gRNA targeting the B2M gene comprises the nucleotide sequence of SEQ ID NO: 466. In some embodiments, the gRNA targeting the B2M gene targets the nucleotide sequence of SEQ ID NO: 417.

In some embodiments, the population of cells further comprises a gRNA targeting the PD1 gene. In some embodiments, the gRNA targeting the PD1 gene comprises the nucleotide sequence of any one of SEQ ID NOs: 1083-1274 and/or targets the nucleotide sequence of any one of SEQ ID NOs: 891-1082. In some embodiments, the gRNA targeting the PD1 gene comprises the nucleotide sequence of SEQ ID NOs: 1086. In some embodiments, the gRNA targeting the PD1 gene targets the nucleotide sequence of SEQ ID NO: 894.

In some embodiments, the population of cells further comprises a gRNA targeting the CTLA-4 gene. In some embodiments, the gRNA targeting the CTLA-4 gene comprises the nucleotide sequence of any one of SEQ ID NOs: 1289-1298. In some embodiments, the gRNA targeting the CTLA-4 gene targets the nucleotide sequence of any one of SEQ ID NOs: 1278-1287. In some embodiments, the gRNA targeting the CTLA-4 gene comprises the nucleotide sequence of SEQ ID NO: 1292. In some embodiments, the gRNA targeting the CTLA-4 gene targets the nucleotide sequence of SEQ ID NO: 1281.

In some embodiments, engineered T cells of the population of cells comprise a deletion of the nucleotide sequence of SEQ ID NO: 76, relative to unmodified T cells. In some embodiments, the disrupted B2M gene comprises an insertion of at least one nucleotide base pair and/or a deletion of at least one nucleotide base pair.

In some embodiments, a disrupted B2M gene of the engineered T cells comprises at least one nucleotide sequence selected from the group consisting of: SEQ ID NO: 1560; SEQ ID NO: 1561; SEQ ID NO: 1562; SEQ ID NO: 1563; SEQ ID NO: 1564; and SEQ ID NO: 1565.

In some embodiments, at least 16% of the cells comprise a B2M gene edited to comprise the nucleotide of SEQ ID NO: 1560; at least 6% of the cells comprise a B2M gene edited to comprise the nucleotide of SEQ ID NO: 1561; at least 4% of the cells comprise a B2M gene edited to comprise the nucleotide of SEQ ID NO: 1562; at least 2% of the cells comprise a B2M gene edited to comprise the nucleotide of SEQ ID NO: 1563; at least 2% of the cells comprise a B2M gene edited to comprise the nucleotide of SEQ ID NO: 1564; and at least 2% of the cells comprise a B2M gene edited to comprise the nucleotide of SEQ ID NO: 1565.

In some embodiments, the vector is an adeno-associated viral (AAV) vector. In some embodiments, the AAV vector is an AAV serotype 6 (AAV6) vector. In some embodiments, the AAV vector comprise the nucleotide sequence of any one of SEQ ID NOs: 1354-1357. In some embodiments, the AAV vector comprise the nucleotide sequence of SEQ ID NO: 1354. In some embodiments, the AAV vector comprise the nucleotide sequence of any one of SEQ ID NOs: 1358-1360. In some embodiments, the AAV vector comprise the nucleotide sequence of SEQ ID NO: 1360. In some embodiments, the AAV vector comprise the nucleotide sequence of any one of SEQ ID NOs: 1365, 1366, 1372, or 1373. In some embodiments, the AAV vector comprise the nucleotide sequence of SEQ ID NOs: 1366 or 1373.

In some embodiments, the donor template comprises the nucleotide sequence of any one of claims 1390-1393. In some embodiments, the donor template comprises the nucleotide sequence of SEQ ID NO: 1390. In some embodiments, the donor template comprises the nucleotide sequence of any one of SEQ ID NOs: 1394-1396. In some embodiments, the donor template comprises the nucleotide sequence of SEQ ID NO: 1396.

In some embodiments, the donor template comprises the nucleotide sequence of any one of SEQ ID NOs: 1401, 1402, 1408, or 1409. In some embodiments, the donor template comprises the nucleotide sequence of SEQ ID NO: 1402 or 1409. It is understood that the inventions described in this specification are not limited to the examples summarized in this Summary. Various other aspects are described and exemplified herein.

BRIEF DESCRIPTION OF THE DRAWINGS

Various aspects of materials and methods for producing genome-edited cells engineered to express a chimeric antigen receptor (CAR) construct on the cell surface, and materials and methods for treating a patient using the genome-edited engineered cells disclosed and described in this specification can be better understood by reference to the accompanying figures, in which:

FIGS. 4A, 4B, 4C, and 4D are a series of graphs depicting a rank ordered list of IVT gRNAs targeting the CIITA gene and their respective activities (% InDel) in 293 cells.

FIG. 6A shows levels of the T cell activation marker CD69 (top panel) and levels of CFSE (marking proliferative history) (bottom panel), and FIG. 6B depicts levels of degranulation (CD107a) and IFNg 1 (left panel) and depicts levels of IL-2 and TNF (right panel) in control and gene edited human T cells.

FIG. 7 is a series of graphs depicting the loss of MHC-II surface expression measured by flow cytometry after treatment of primary human T cells with RNPs containing RNPs to the CIITA or RFX-5 genes.

FIG. 14 is a schematic representation of model graphics of AAV constructs to be used in production of AAV virus for delivery of donor DNA templates for repair of Cas9 induced double stranded breaks and site-specific transgene insertion.

FIG. 30B is a graph that shows TRAC−CD70CAR+ T cells induce cell lysis of renal cell carcinoma derived cell lines (24 hour and 48 hour time points).

FIG. 32 is flow cytometry data showing the production of anti-BCMA (CTX152 and CTX154) CAR-T cells with TCR and B2M deletions (TRAC−/B2M-BCMA CAR+ Cells). TRAC and B2M genes were disrupted using CRISPR/CAS9 and the CAR constructs were inserted into the TRAC locus using homologous directed repair. Approximately 77% of the T-Cells were TCR−/B2M− as measured by FACS (top panel). CAR+ cells were both positive for GFP expression and recombinant BCMA binding (bottom panel). These CAR T-Cells were produced according to the methods described in Example 15. x and y axes are depicted in logarithmic scale.

FIG. 35A is flow cytometry data demonstrating GranzymeB activity only in the CD19+ expressing target cells (Nalm6) that interacted with TRAC−/B2M−CD19CAR+ T cells.

FIG. 35B is a graph showing that TRAC−/B2M− CD19CAR+ T cells secrete high levels of IFNγ when cultured with CD19 positive Nalm6 cells.

FIG. 35C is a graph of cell killing data showing that TRAC−/B2M−CD19CAR+ T cells selectively kills Nalm6 cells at low T cell to target cell ratios.

FIG. 50 shows flow cytometry plots demonstating that the health of TRAC−/B2M−/anti-CD19+CAR T cells is maintained at day 21 post gene editing. Cells were assayed for low exhaustion markers, LAGS and PD1 (left graph), as well as low senenscence marker, CD57 (right graph).

FIG. 54A shows graphs demonstrating that allogeneic anti-BCMA CAR-T cells efficiently and selectively kill the BCMA-expressing MM cell line MM.1S in a 4-hour cell kill assay, while sparing the BCMA-negative leukemic line K562. FIG. 54B is a graph showing that the cells also selectively secrete the T cell activation cytokines IFNγ and IL-2, which are upregulated in response to induction only by MM.1S cells. Values below the limit of detection are shown as hollow data points. Potent cell kill was also observed upon exposure of anti-BCMA CAR-T cells to additional MM cell lines.

BRIEF DESCRIPTION OF THE SEQUENCE LISTING

Figure 1:
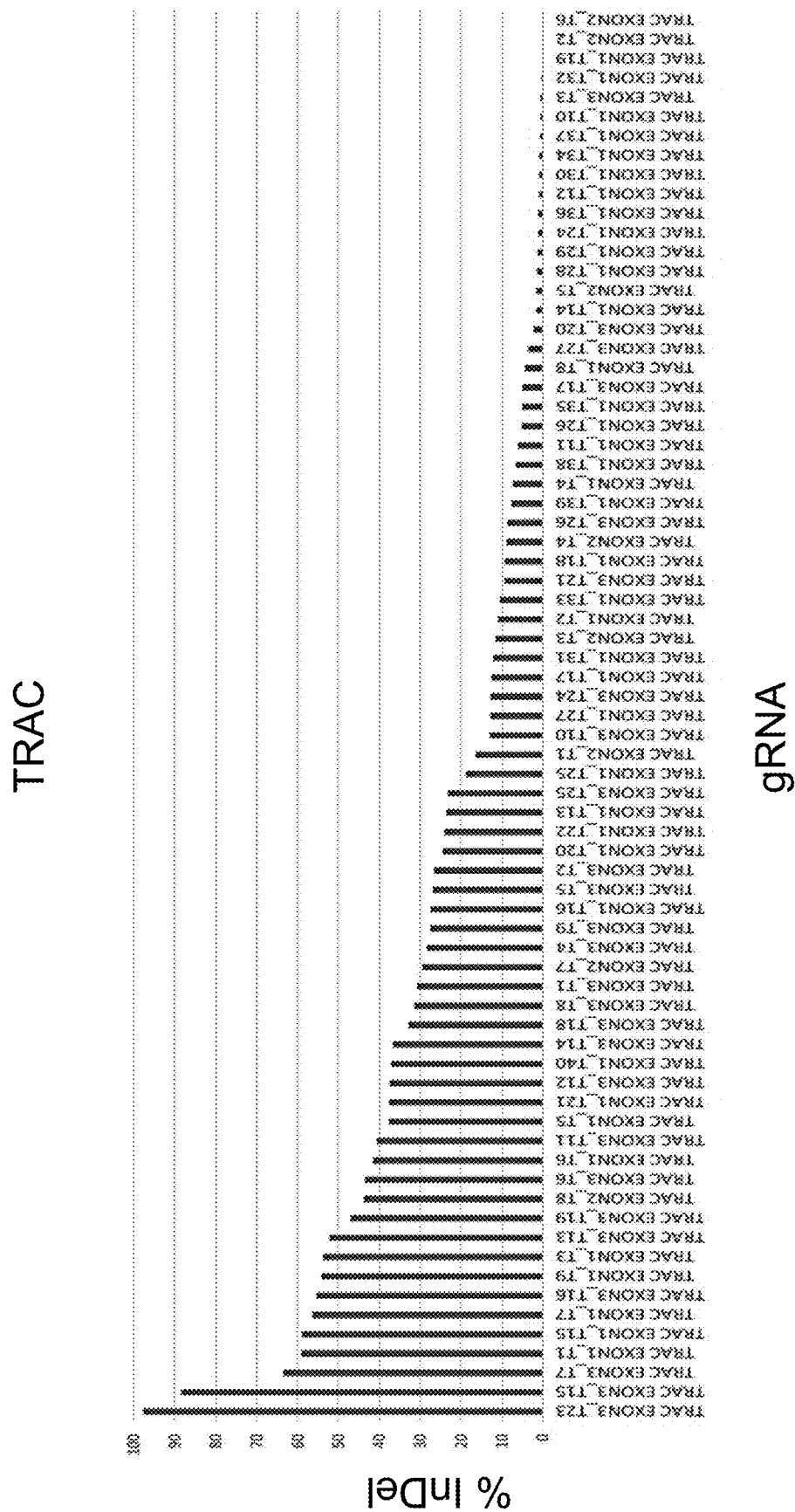
FIG. 1 is a graph depicting a rank ordered list of IVT gRNAs targeting the TRAC gene and their respective activities (% InDel) in 293 cells.
Figure 2A:
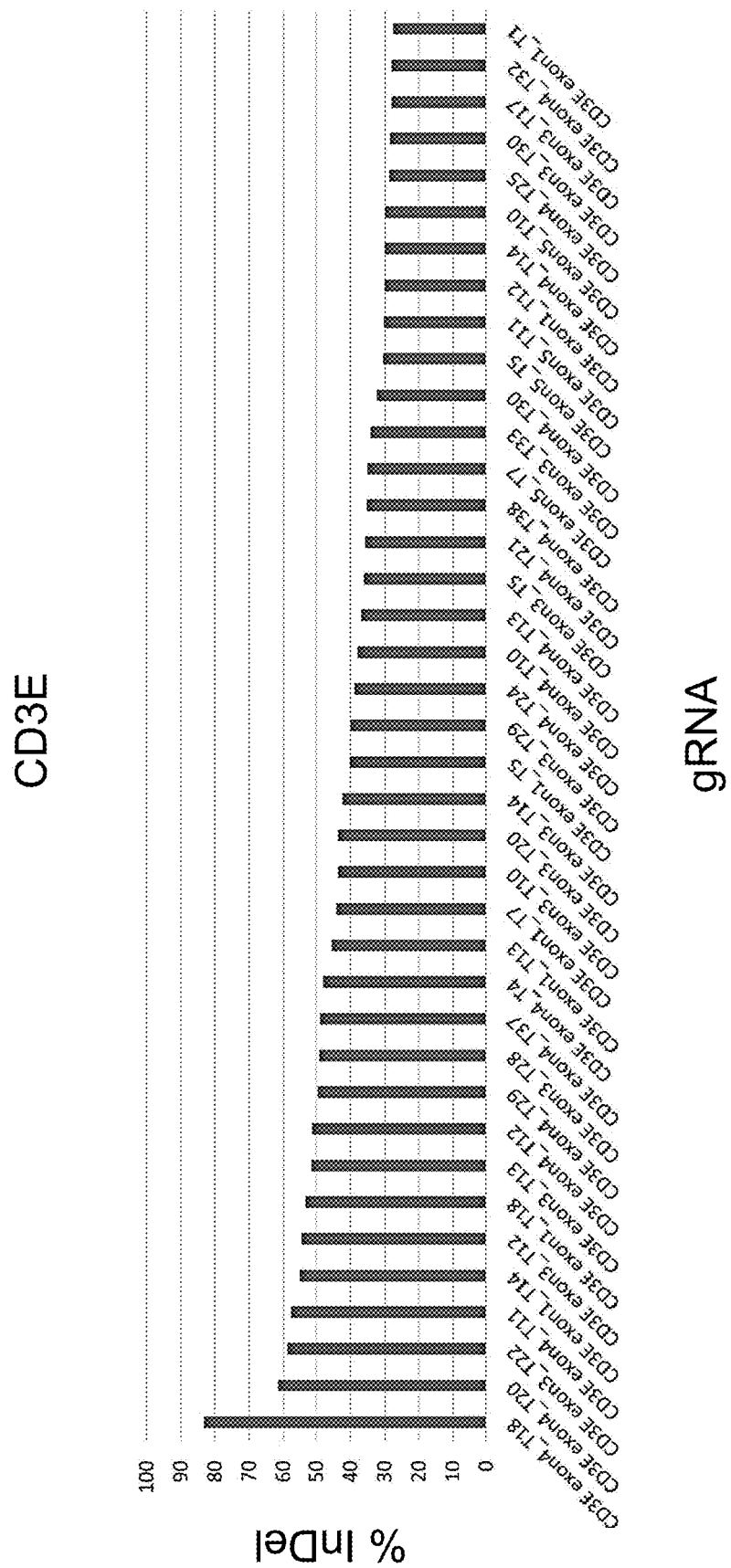
FIGS. 2A and 2B are a series of graphs depicting a rank ordered list of IVT gRNAs targeting the CD3-epsilon (CD3E) gene and their respective activities (% InDel) in 293 cells.
Figure 2B:
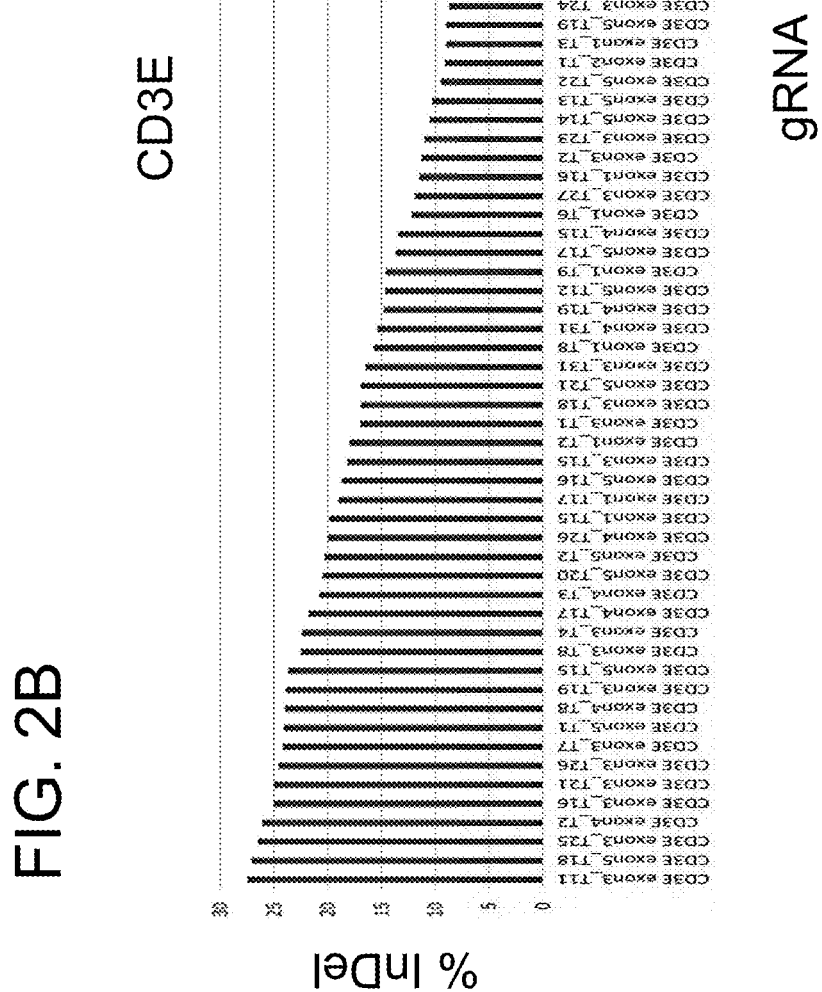
Figure 3:
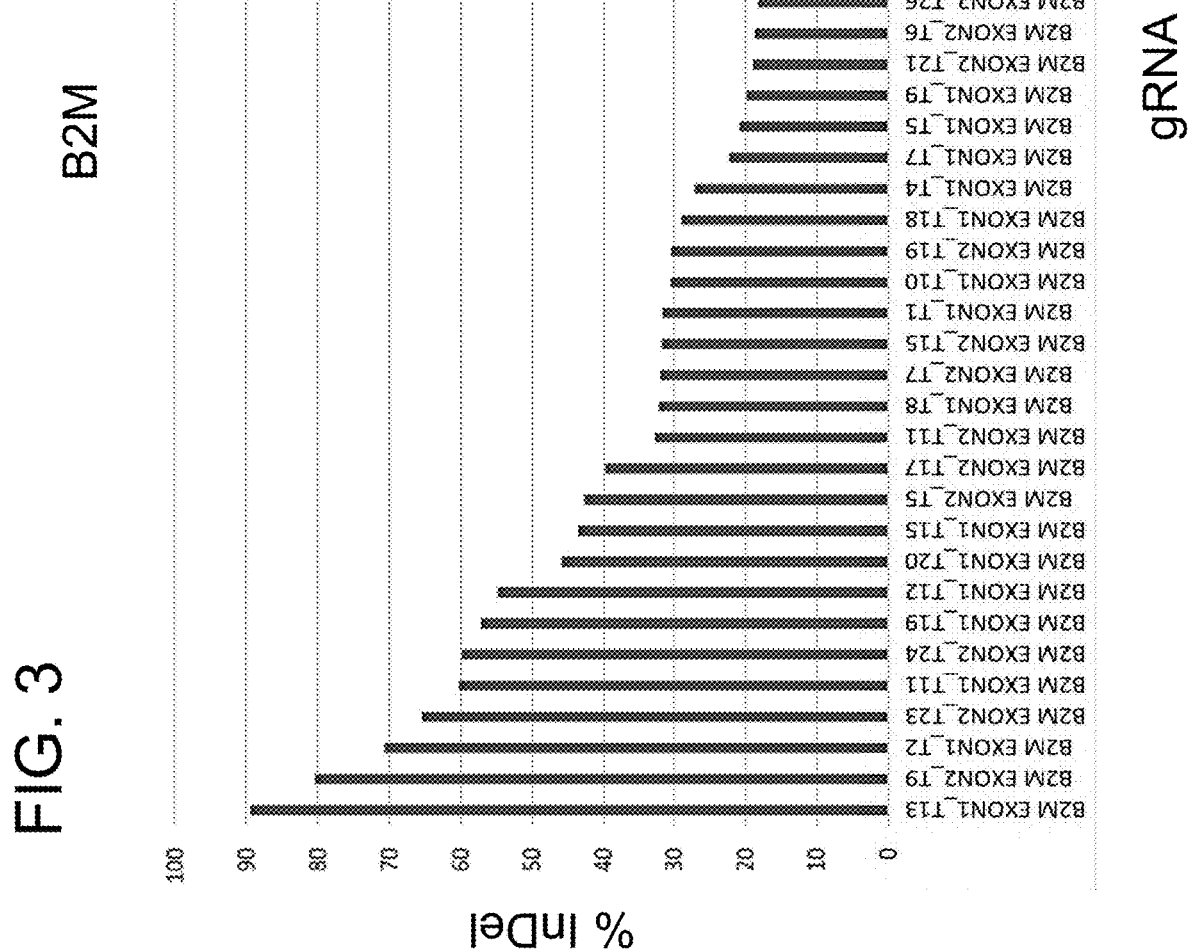
FIG. 3 is a graph depicting a rank ordered list of IVT gRNAs targeting the B2M gene and their respective activities (% InDel) in 293 cells.
Figure 4A:
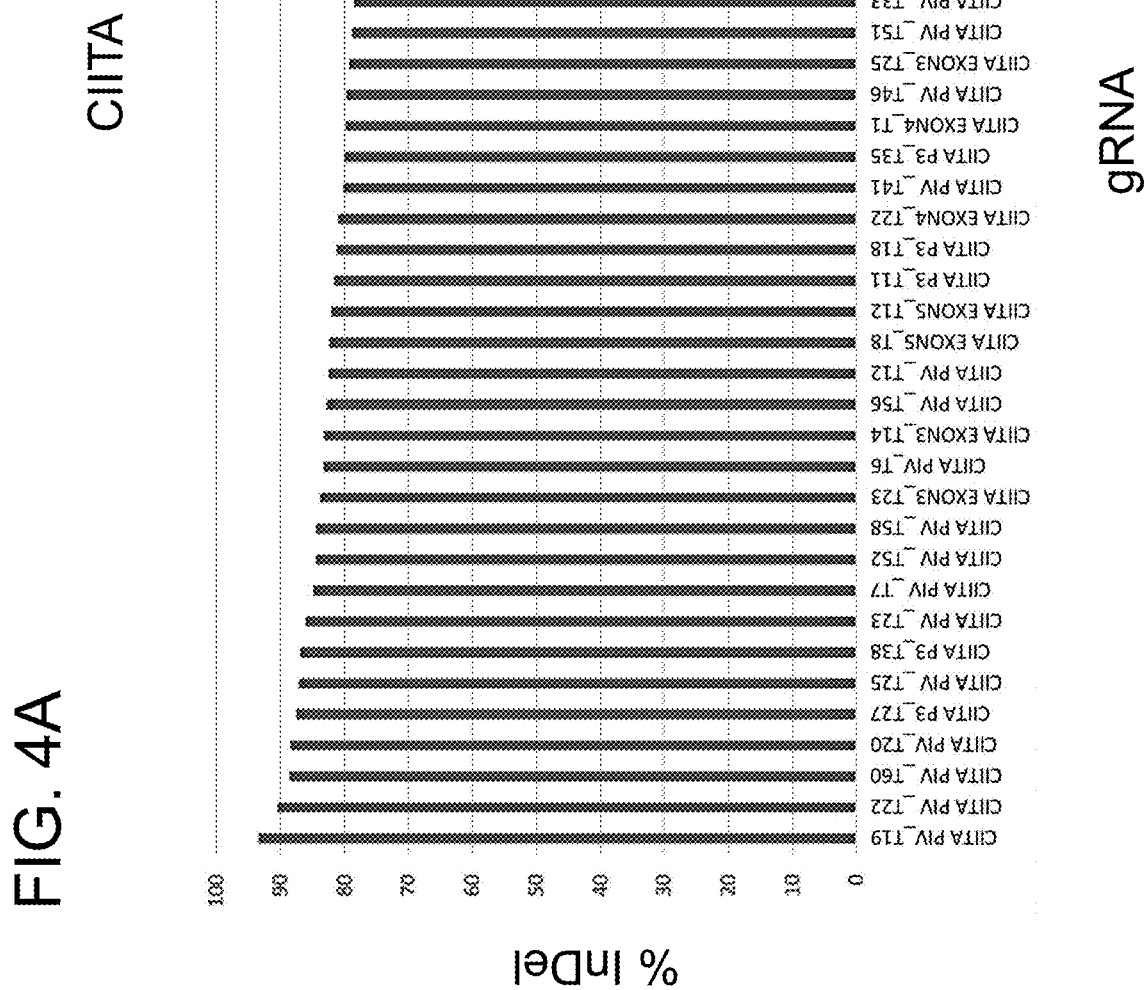
Figure 4B:
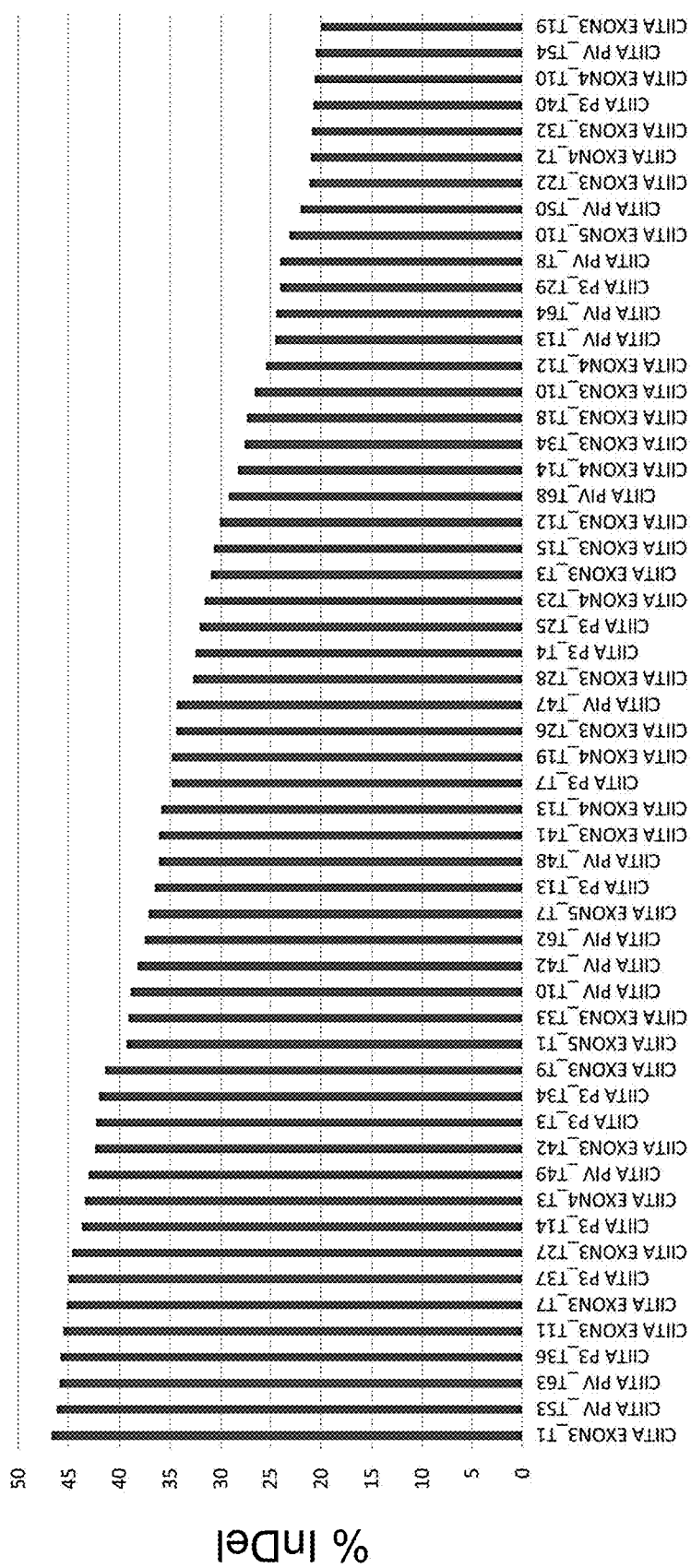
Figure 4D:
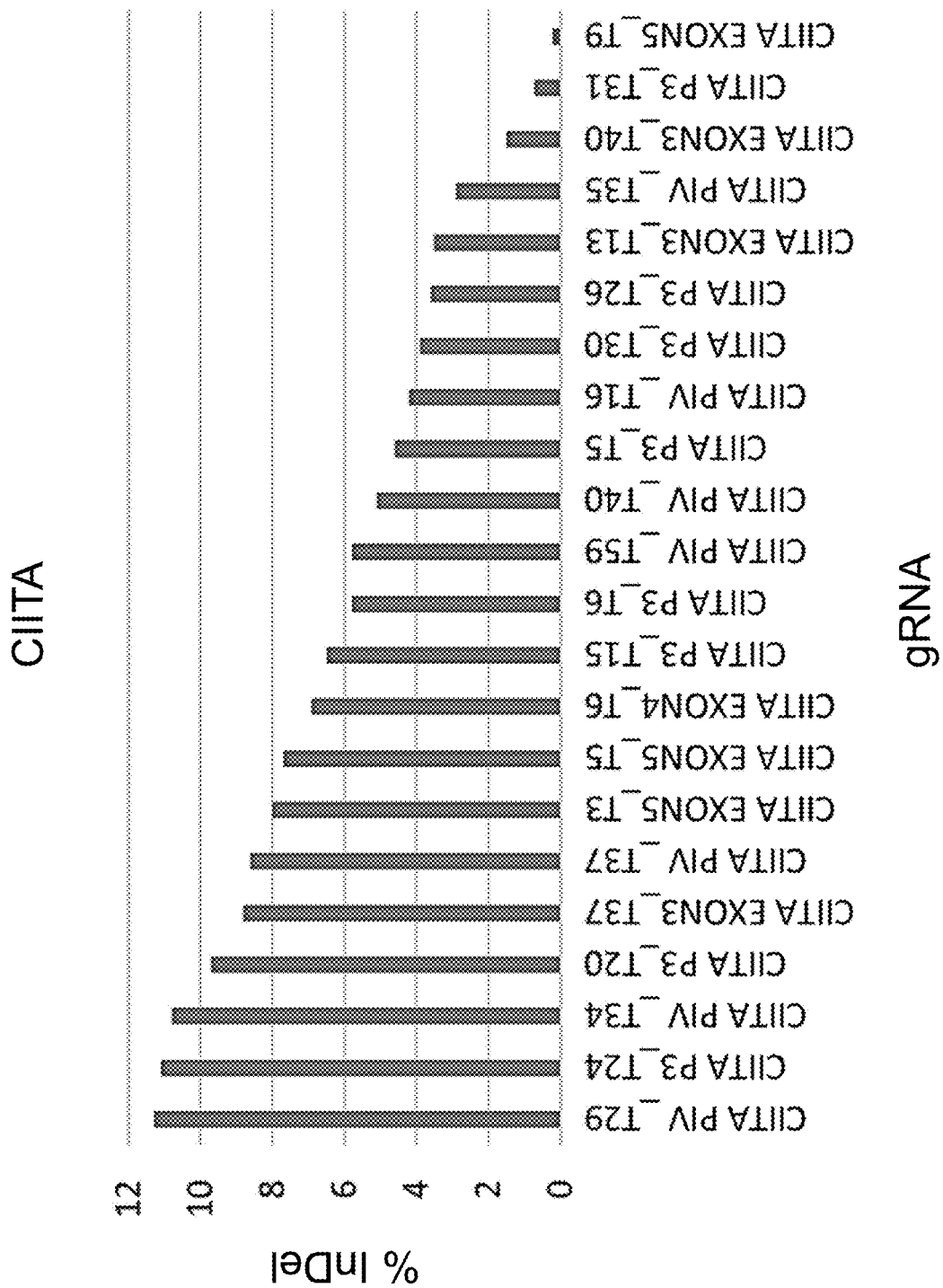

SEQ ID NOs: 1-3 are sgRNA backbone sequences (Table 1).

SEQ ID NOs: 4-6 are homing endonuclease sequences.

SEQ ID NOs: 7-82 are TRAC gene target sequences (Table 4).

SEQ ID NOs: 83-158 are gRNA spacer sequences targeting the TRAC gene (Table 4).

SEQ ID NOs: 159-283 are CD3E gene target sequences (Table 5).

SEQ ID NOs: 384-408 are gRNA spacer sequences targeting the CD3E gene (Table 5).

SEQ ID NOs: 409-457 are B2M gene target sequences (Table 6).

SEQ ID NOs: 458-506 are gRNA spacer sequences targeting the B2M gene (Table 6).

SEQ ID NOs: 507-698 are CIITA gene target sequences (Table 7).

SEQ ID NOs: 699-890 are gRNA spacer sequences targeting the CIITA gene (Table 7).

SEQ ID NOs: 891-1082 are PD1 gene target sequences (Table 8).

SEQ ID NOs: 1083-1274 are gRNA spacer sequences targeting the PD1 gene (Table 8).

SEQ ID NO: 1275 is the nucleotide sequence for the CAR of CTX-145b (Table 36).

SEQ ID NO: 1276 is the amino acid sequence for the CAR of CTX-145b (Table 36).

SEQ ID NOs: 1277-1287 are CTLA-4 gene target sequences (Table 10).

SEQ ID NOs: 1288-1298 are gRNA spacer sequences targeting the CTLA-4 gene (Table 10).

SEQ ID NO: 1299 is a TRAC gene target sequence (Table 11).

SEQ ID NO: 1300 is a PD1 gene target sequence (Table 11).

SEQ ID NOs: 1301 and 1302 are AAVS1 target sequences (Table 11).

SEQ ID NOs: 1303 and 1305 are CD52 target sequenes (Table 11).

SEQ ID NOs: 1305-1307 are RFX5 target sequences (Table 11).

SEQ ID NO: 1308 is a gRNA spacer sequence targeting the AAVS1 gene.

SEQ ID NOs: 1309-1311 are gRNA spacer sequences targeting the RFX5 gene.

SEQ ID NO: 1312 is a gRNA spacer sequence targeting the CD52 gene.

SEQ ID NOs: 1313-1338 are donor template component sequences for generating the anti-CD19 CAR T cells (see Table 12).

SEQ ID NO: 1339 is the nucleotide sequence for the 4-1BB co-stimulatory domain.

SEQ ID NO: 1340 is the amino acid sequence for the 4-1BB co-stimulatory domain.

SEQ ID NO: 1341 is a linker sequence.

SEQ ID NOs: 1342-1347 are chemically-modified and unmodified sgRNA sequences for B2M, TRAC, and AAVS1 (see Table 32).

SEQ ID NOs: 1348-1386 are rAAV sequences of various donor templates (see Table 34).

SEQ ID NOs: 1387-1422 are left homology arm (LHA) to right homology arm (RHA) sequences of various donor templates (see Table 35).

SEQ ID NOs: 1423-1448 are CAR nucleotide sequences of donor templates of the present disclosure (see Table 36).

SEQ ID NOs: 1449-1474 are CAR amino acid sequences encoded by donor templates of the present disclosure (see Table 37).

SEQ ID NOs: 1475-1498 are scFv nucleic acid sequences of CARs of the present disclosure (see Table 38).

SEQ ID NOs: 1499-1522 are scFv amino acid sequences encoded by CARs of the present disclosure (see Table 39).

SEQ ID NOs: 1523-1531 are anti-BCMA light chain and heavy chain sequences (see Table 39).

SEQ ID NOs: 1532-1553 are plasmid sequences of the present disclosure.

SEQ ID NOs: 1554-1559 are primer sequences used in a ddPCR assay (see Table 25).

SEQ ID NOs: 1560-1565 are gene edited sequences in the B2M gene (Table 12.3).

SEQ ID NOs: 1566-1573 are gene edited sequences in the TRAC gene (Table 12.4).

SEQ ID NOs: 1574 and 1575 are chemically-modified and unmodified sgRNA sequences for PD1 (see Table 32).

SEQ ID NOs: 1576-1577 are ITR sequences (Table 12).

SEQ ID NOs: 1578-1582 are nucleotide sequences for the left homology arms and right homology arms used for CTX-139.1-CTX-139.3 (Table 12).

SEQ ID NO: 1586 is a CD8 signal peptide sequence (Table 12).

SEQ ID NOs: 1587 and 1588 are are chemically-modified and unmodified sgRNA sequences for TRAC (EXON1_T7) (see Table 32).

SEQ ID NOs: 1589-1597 are the heavy chain, light chain and linker sequences for example anti-BCMA, anti-CD70, and anti-CD19 scFv molecules (Table 39).

SEQ ID NO: 1598 is the leader peptide sequence for the anti-CD19 CAR (Table 12). SEQ ID NO: 1599 is the CD8a transmembrane sequence without the linker (Table 12).

SEQ ID NO: 1600 is the CD8a peptide sequence.

SEQ ID NO: 1601 is the CD28 co-stimulatory domain peptide sequence.

SEQ ID NO: 1602 is the CD3-zeta co-stimulatory domain peptide sequence.

DETAILED DESCRIPTION

Therapeutic Approach

CRISPR edited cells such as, for example, CRISPR edited T cells, can have therapeutic uses in multiple disease states. By way of non-limiting example, the nucleic acids, vectors, cells, methods, and other materials provided in the present disclosure are useful in treating cancer, inflammatory disease and/or autoimmune disease.

Gene editing provides an important improvement over existing or potential therapies, such as introduction of target gene expression cassettes through lentivirus delivery and integration. Gene editing to modulate gene activity and/or expression has the advantage of precise genome modification and lower adverse effects, and for restoration of correct expression levels and temporal control.

The materials and methods provided herein are useful in modulating the activity of a target gene. For example, the target gene can be a gene sequence associated with host versus graft response, a gene sequence associated with graft versus host response, a gene sequence encoding an immune suppressor (e.g.: checkpoint inhibitor), or any combination thereof.

The target gene can be a gene sequence associated with a graft versus host response that is selected from the group consisting of TRAC, CD3-episolon (CD3ε), and combinations thereof. TRAC and CD3ε are components of the T cell receptor (TCR). Disrupting them by gene editing will take away the ability of the T cells to cause graft versus host disease.

The target gene can be a gene sequence associated with a host versus graft response that is selected from the group consisting of B2M, CIITA, RFX5, and combinations thereof. B2M is a common (invariant) component of MHC I complexes. Its ablation by gene editing will prevent host versus therapeutic allogeneic T cells responses leading to increased allogeneic T cell persistence. CIITA and RFX5 are components of a transcription regulatory complex that is required for the expression of MHC II genes. Disrupting them by gene editing will prevent host versus therapeutic allogeneic T cells responses leading to increased allogeneic T cell persistence.

The target gene can be a gene sequence encoding a checkpoint inhibitor that is selected from the group consisting of PD1, CTLA-4, and combinations thereof. PDCD1 (PD1) and CTLA4 are immune checkpoint molecules that are upregulated in activated T cells and serve to dampen or stop T cell responses. Disrupting them by gene editing could lead to more persistent and/or potent therapeutic T cell responses.

The target gene can be a sequence associated with pharmacological modulation of a cell. For example, CD52 is the target of the lympho-depleting therapeutic antibody alemtuzumab. Disruption of CD52 by gene editing will make therapeutic T cells resistant to alemtuzumab which may be useful in certain cancer settings.

Deletion of the above genes can be achieved with guide RNAs that have chosen from small (<5) to medium scale (>50) screens. The examples provided herein further illustrate the selection of various target regions and gRNAs useful for the creation of indels that result in disruption of a target gene, for example, reduction or elimination of gene expression and or function. The examples provided herein further illustrate the selection of various target regions and gRNAs useful for the creation of DSBs that fascillitate insertion of a donor template into the genone. Examples of target genes associated with graft versus host disease, host versus graph disease and/or immune suppression. In some aspects, the guide RNA is a gRNA comprising a sequence disclosed herein.

The methods use chimeric antigen receptor constructs (CARs) that are inserted into genomic loci by using guide RNA/Cas9 to induce a double stranded break that is repaired by HDR using an AAV6 delivered donor template with homology around the cut site.

A chimeric antigen receptor (CAR) is an artificially constructed hybrid protein or polypeptide containing an antigen binding domain of an antibody (e.g., a single chain variable fragment (scFv)) linked to T-cell signaling or T-cell activation domains. CARs have the ability to redirect T-cell specificity and reactivity toward a selected target in a non-MHC-restricted manner, exploiting the antigen-binding properties of monoclonal antibodies. The non-MHC-restricted antigen recognition gives T-cells expressing CARs the ability to recognize an antigen independent of antigen processing, thus bypassing a major mechanism of tumor escape. Moreover, when expressed in T-cells, CARs advantageously do not dimerize with endogenous T-cell receptor (TCR) alpha and beta chains.

The materials and methods provided herein knock-in a nucleic acid encoding a chimeric antigen receptor (CAR) in or near a locus of a target gene by permanently deleting at least a portion of the target gene and inserting a nucleic acid encoding the CAR. The CARs used in the materials and methods provided herein include (i) an ectodomain comprising an antigen recognition region; (ii) a transmembrane domain, and (iii) an endodomain comprising at least one costimulatory domain. The nucleic acid encoding the CAR can also include a promoter, one or more gene regulatory elements, or a combination thereof. For example, the gene regulatory element can be an enhancer sequence, an intron sequence, a polyadenylation (poly(A)) sequence, and/or combinations thereof.

The donor for insertion by homology directed repair (HDR) contains the corrected sequence with small or large flanking homology arms to allow for annealing. HDR is essentially an error-free mechanism that uses a supplied homologous DNA sequence as a template during DSB repair. The rate of homology directed repair (HDR) is a function of the distance between the mutation and the cut site so choosing overlapping or nearby target sites is important. Templates can include extra sequences flanked by the homologous regions or can contain a sequence that differs from the genomic sequence, thus allowing sequence editing.

The target gene can be associated with an immune response in a subject, wherein disrupting expression of the target gene will modulate the immune response. For example, creating small insertions or deletions in the target gene, and/or permanently deleting at least a protion of the target gene and/or inserting an exogenous sequence into the target gene can disrupt expression of target gene. The target gene sequence can be associated with host versus graft response, a gene sequence associated with graft versus host response, a gene sequence encoding a checkpoint inhibitor, and/or any combination thereof.

Target genes associated with a graft versus host (GVH) response include, for example, TRAC, CD3-episolon (CDR), and combinations thereof. Permanently deleting at least a portion of these genes, creating small insertions or deletions in these genes, and/or inserting the nucleic acid encoding the CAR can reduce GVH response in a subject. The reduction in GVH response can be partial or complete.

Target genes associated with a host versus graft (HVG) response include, for example, B2M, CIITA, RFX5, and combinations thereof. Permanently deleting at least a portion of these genes, creating small insertions or deletions in these genes, and/or inserting the nucleic acid encoding the CAR can reduce HVG response in a subject. The reduction in HVG response can be partial or complete.

Target genes associated with immune suppression include, for example, checkpoint inhibitors such PD1, CTLA-4, and combinations thereof. Permanently deleting at least a portion of these genes, creating small insertions or deletions in these genes, and/or inserting the nucleic acid encoding the CAR can reduce immune suppression in a subject. The reduction in immune suppression can be partial or complete.

The target gene can be associated with pharmacological modulation of a cell, wherein disrupting expression of the target gene will modulate one or pharmacological characteristics of the cell.

Target genes associated with pharmacological modulation of a cell include, for example, CD52. Permanently deleting at least a portion of these genes, creating small insertions or deletions in these genes, and/or inserting the nucleic acid encoding the CAR can positively or negatively modulate one or pharmacological characteristics of the cell. The modulation of one or pharmacological characteristics of the cell can be partial or complete. For example, permanently deleting at least a portion of these genes and inserting the nucleic acid encoding the CAR can positively impact or otherwise allow the CAR T cells to survive. Alternatively, permanently deleting at least a portion of these genes and inserting the nucleic acid encoding the CAR can negatively impact or otherwise kill the CAR T cells.

The donor templates used in the nucleic acid constructs encoding the CAR can also include a minigene or cDNA. For example, the minigene or cDNA can comprise a gene sequence associated with pharmacological modulation of a cell. The gene sequence can encode Her2.

A Her2 gene sequence can be permanently inserted at a different locus in the target gene or at a different locus in the genome from where the nucleic acid encoding the CAR construct is inserted.

Provided herein are methods to DSBs that induce small insertions or deletions in a target gene resulting in the disruption (e.g.: reduction or elimination of gene expression and/or function) of the target gene.

Also, provided herein are methods to creat DBSs and/or permanently delete within or near the target gene and to insert a nucleic acid construct encoding a CAR construct in the gene by inducing a double stranded break with Cas9 and a sgRNA in a target sequence (or a pair of double stranded breaks using two appropriate sgRNAs), and to provide a donor DNA template to induce Homology-Directed Repair (HDR). In some embodiments, the donor DNA template can be a short single stranded oligonucleotide, a short double stranded oligonucleotide, a long single or double stranded DNA molecule. These methods use gRNAs and donor DNA molecules for each target. In some embodiments, the donor DNA is single or double stranded DNA having homologous arms to the corresponding region. In some embodiments, the homologous arms are directed to the nuclease-targeted region of a gene selected from the group consisting of TRAC (chr14:22278151-22553663), CD3ε (chr11:118301545-118319175), B2M (chr15:44708477-44721877), CIITA (chr16:10874198-10935281), RFX5 (chr1:151337640-151350251), PD1 (chr2:241846881-241861908), CTLA-4 (chr2:203864786-203876960), CD52 (chr1:26314957-26323523), PPP1R12C (chr19:55087913-55120559), and combinations thereof.

Provided herein are methods to knock-in target cDNA or a minigene (comprised of one or more exons and introns or natural or synthetic introns) into the locus of the corresponding gene. These methods use a pair of sgRNA targeting the first exon and/or the first intron of the target gene. In some embodiments, the donor DNA is single or double stranded DNA having homologous arms to the nuclease-targeted region of a Her2 gene selected.

Provided herein are cellular methods (e.g., ex vivo or in vivo) methods for using genome engineering tools to create permanent changes to the genome by: 1) creating DSBs to induce small insertions, deletions or mutations within or near a target gene, 2) deleting within or near the target gene or other DNA sequences that encode regulatory elements of the target gene and inserting, by HDR, a nucleic acid encoding a knock-in CAR construct within or near the target gene or other DNA sequences that encode regulatory elements of the target gene, or 3) creating DSBs within or near the target gene and inserting a nucleic acid construct within or near the target gene by HDR. Such methods use endonucleases, such as CRISPR-associated (Cas9, Cpf1 and the like) nucleases, to permanently delete, insert, edit, correct, or replace one or more or exons or portions thereof (i.e., mutations within or near coding and/or splicing sequences) or insert in the genomic locus of the target gene or other DNA sequences that encode regulatory elements of the target gene. In this way, the examples set forth in the present disclosure restore the reading frame or the wild-type sequence of, or otherwise correct the gene with a single treatment (rather than deliver potential therapies for the lifetime of the patient).

Provided herein are methods for treating a patient with a medical condition. An aspect of such method is an ex vivo cell-based therapy. For example, peripheral blood mononuclear cells are isolated from the patient. Next, the chromosomal DNA of these cells is edited using the materials and methods described herein. Finally, the genome-edited cells are implanted into the patient.

Also provided herein are methods for reducing volume of a tumor in a subject, comprising administering to the subject a dose of a pharmaceutical composition comprising a population of cells (e.g., engineered T cells) of the present disclosure and reducing the volume of the tumor in the subject by at least 50% (e.g., at least 55%, at least 60%, at least 65%, at least 70%, or at least 75%) relative to control (e.g., an untreated subject).

Further provided herein are methods for increasing survival rate in a subject, comprising administering to the subject a dose of a pharmaceutical composition comprising a population of cells (e.g., engineered T cells) of the present disclosure and increasing the survival rate in the subject by at least 50% % (e.g., at least 55%, at least 60%, at least 65%, at least 70%, or at least 75%) relative to control (e.g., an untreated subject).

In some embodiments, the composition comprises at $1\times10^5$ to $1\times10^6$ cells. In some embodiments, the pharmaceutical composition comprises at $1\times10^5$ to $2\times10^6$ cells. For example, the composition may comprise $1\times10^5$, $2\times10^5$, $3\times10^5$, $4\times10^5$, $5\times10^5$, $6\times10^5$, $7\times10^5$, $8\times10^5$, $9\times10^5$, $1\times10^6$, or $2\times10^6$. In some embodiments, the pharmaceutical composition comprises $1\times10^5$ to $5\times10^5$ cells, $5\times10^5$ to $1\times10^6$ cells, or $5\times10^5$ to $1.5\times10^6$ cells.

Another aspect of an ex vivo cell-based therapy may include, for example, isolating T cells from a donor. Next, the chromosomal DNA of these cells are edited using the materials and methods described herein. Finally, the genome-edited cells are implanted into a patient.

In certain aspects, T cells are isolated from more than one donor. These cells are edited using the materials and methods described herein. Finally, the genome-edited cells are implanted into a patient.

One advantage of an ex vivo cell therapy approach is the ability to conduct a comprehensive analysis of the therapeutic prior to administration. Nuclease-based therapeutics have some level of off-target effects. Performing gene correction ex vivo allows one to fully characterize the corrected cell population prior to implantation. The present disclosure includes sequencing the entire genome of the corrected cells to ensure that the off-target effects, if any, are in genomic locations associated with minimal risk to the patient. Furthermore, populations of specific cells, including clonal populations, can be isolated prior to implantation.

Another embodiment of such methods also includes an in vivo based therapy. In this method, chromosomal DNA of the cells in the patient is edited using the materials and methods described herein. In some embodiments, the cells are T cells, such as $CD4^+$ T-cells, $CD8^+$ T-cells, or a combination thereof.

Also provided herein is a cellular method for editing the target gene in a cell by genome editing. For example, a cell is isolated from a patient or animal. Then, the chromosomal DNA of the cell is edited using the materials and methods described herein.

The methods provided herein, in some embodiments, involve one or a combination of the following: 1) creating indels within or near the target gene or other DNA sequences that encode regulatory elements of the target gene, 2) deleting within or near the target gene or other DNA sequences that encode regulatory elements of the target gene, 3) inserting, by HDR or NHEJ, a nucleic acid encoding a knock-in CAR construct within or near the target gene or other DNA sequences that encode regulatory elements of the target gene, or 4) deletion of at least a portion of the target gene and/or knocking-in target cDNA or a minigene (comprised of one or more exons or introns or natural or synthetic introns) or introducing exogenous target DNA or cDNA sequence or a fragment thereof into the locus of the gene.

The knock-in strategies utilize a donor DNA template in Homology-Directed Repair (HDR) or Non-Homologous End Joining (NHEJ). HDR in either strategy may be accomplished by making one or more single-stranded breaks (SSBs) or double-stranded breaks (DSBs) at specific sites in the genome by using one or more endonucleases.

For example, the knock-in strategy involves knocking-in target cDNA or a minigene (comprised of, natural or synthetic enhancer and promoter, one or more exons, and natural or synthetic introns, and natural or synthetic 3'UTR and polyadenylation signal) into the locus of the gene using a gRNA (e.g., crRNA+tracrRNA, or sgRNA) or a pair of sgRNAs targeting upstream of or in the first or other exon and/or intron of the target gene. The donor DNA can be a single or double stranded DNA having homologous arms to the nuclease-targeted region of the target gene. For example, the donor DNA can be a single or double stranded DNA having homologous arms to the nuclease-targeted region of a gene selected from the group consisting of TRAC (chr14:22278151-22553663), CD3ε (chr11:118301545-118319175), B2M (chr15:44708477-44721877), CIITA (chr16:10874198-10935281), RFX5 (chr1:151337640-151350251), PD1 (chr2:241846881-241861908), CTLA-4 (chr2:203864786-203876960), CD52 (chr1:26314957-26323523), PPP1R12C (chr19:55087913-55120559), and combinations thereof.

For example, the deletion strategy involves, in some aspects, deleting one or more introns, exons, regulatory regions, of the target gene, partial segments of the target gene or the entire target gene sequence using one or more endonucleases and one or more gRNAs or sgRNAs.

As another example, the deletion strategy involves, in some aspects, deleting one or more nucleic acids, of one or more target genes, resulting in small insertions or deletions (indels) using one or more endonucleases and one or more gRNAs or sgRNAs.

In addition to the above genome editing strategies, another example editing strategy involves modulating expression, function, or activity of a target gene by editing in the regulatory sequence.

In addition to the editing options listed above, Cas9 or similar proteins can be used to target effector domains to the same target sites that may be identified for editing, or additional target sites within range of the effector domain. A range of chromatin modifying enzymes, methylases or demethlyases may be used to alter expression of the target gene. One possibility is increasing the expression of the target protein if the mutation leads to lower activity. These types of epigenetic regulation have some advantages, particularly as they are limited in possible off-target effects.

A number of types of genomic target sites are present in addition to mutations in the coding and splicing sequences.

The regulation of transcription and translation implicates a number of different classes of sites that interact with cellular proteins or nucleotides. Often the DNA binding sites of transcription factors or other proteins can be targeted for mutation or deletion to study the role of the site, though they can also be targeted to change gene expression. Sites can be added through non-homologous end joining NHEJ or direct genome editing by homology directed repair (HDR). Increased use of genome sequencing, RNA expression and genome-wide studies of transcription factor binding have increased the ability to identify how the sites lead to developmental or temporal gene regulation. These control systems may be direct or may involve extensive cooperative regulation that can require the integration of activities from multiple enhancers. Transcription factors typically bind 6-12 bp-long degenerate DNA sequences. The low level of specificity provided by individual sites suggests that complex interactions and rules are involved in binding and the functional outcome. Binding sites with less degeneracy may provide simpler means of regulation. Artificial transcription factors can be designed to specify longer sequences that have less similar sequences in the genome and have lower potential for off-target cleavage. Any of these types of binding sites can be mutated, deleted or even created to enable changes in gene regulation or expression (Canver, M. C. et al., *Nature* (2015)).

Another class of gene regulatory regions having these features is microRNA (miRNA) binding sites. miRNAs are non-coding RNAs that play key roles in posttranscriptional gene regulation. miRNA may regulate the expression of 30% of all mammalian protein-encoding genes. Specific and potent gene silencing by double stranded RNA (RNAi) was discovered, plus additional small noncoding RNA (Canver, M. C. et al., *Nature* (2015)). The largest class of noncoding RNAs important for gene silencing are miRNAs. In mammals, miRNAs are first transcribed as long RNA transcripts, which can be separate transcriptional units, part of protein introns, or other transcripts. The long transcripts are called primary miRNA (pri-miRNA) that include imperfectly base-paired hairpin structures. These pri-miRNA are cleaved into one or more shorter precursor miRNAs (pre-miRNAs) by Microprocessor, a protein complex in the nucleus, involving Drosha.

Pre-miRNAs are short stem loops ~70 nucleotides in length with a 2-nucleotide 3'-overhang that are exported, into the mature 19-25 nucleotide miRNA:miRNA* duplexes. The miRNA strand with lower base pairing stability (the guide strand) can be loaded onto the RNA-induced silencing complex (RISC). The passenger guide strand (marked with *), may be functional, but is usually degraded. The mature miRNA tethers RISC to partly complementary sequence motifs in target mRNAs predominantly found within the 3' untranslated regions (UTRs) and induces posttranscriptional gene silencing (Bartel, D. P. *Cell* 136, 215-233 (2009); Saj, A. & Lai, E. C. *Curr Opin Genet Dev* 21, 504-510 (2011)).

miRNAs are important in development, differentiation, cell cycle and growth control, and in virtually all biological pathways in mammals and other multicellular organisms. miRNAs are also involved in cell cycle control, apoptosis and stem cell differentiation, hematopoiesis, hypoxia, muscle development, neurogenesis, insulin secretion, cholesterol metabolism, aging, viral replication and immune responses.

A single miRNA can target hundreds of different mRNA transcripts, while an individual transcript can be targeted by many different miRNAs. More than 28645 microRNAs have been annotated in the latest release of miRBase (v.21). Some miRNAs are encoded by multiple loci, some of which are expressed from tandemly co-transcribed clusters. The features allow for complex regulatory networks with multiple pathways and feedback controls. miRNAs are integral parts of these feedback and regulatory circuits and can help regulate gene expression by keeping protein production within limits (Herranz, H. & Cohen, S. M. *Genes Dev* 24, 1339-1344 (2010); Posadas, D. M. & Carthew, R. W. *Curr Opin Genet Dev* 27, 1-6 (2014)).

miRNAs are also important in a large number of human diseases that are associated with abnormal miRNA expression. This association underscores the importance of the miRNA regulatory pathway. Recent miRNA deletion studies have linked miRNA with regulation of the immune responses (Stern-Ginossar, N. et al., *Science* 317, 376-381 (2007)).

miRNAs also have a strong link to cancer and may play a role in different types of cancer. miRNAs have been found to be downregulated in a number of tumors. miRNAs are important in the regulation of key cancer-related pathways, such as cell cycle control and the DNA damage response, and are therefore used in diagnosis and are being targeted clinically. MicroRNAs delicately regulate the balance of angiogenesis, such that experiments depleting all microRNAs suppresses tumor angiogenesis (Chen, S. et al., *Genes Dev* 28, 1054-1067 (2014)).

As has been shown for protein coding genes, miRNA genes are also subject to epigenetic changes occurring with cancer. Many miRNA loci are associated with CpG islands increasing their opportunity for regulation by DNA methylation (Weber, B., Stresemann, C., Brueckner, B. & Lyko, F. *Cell Cycle* 6, 1001-1005 (2007)). The majority of studies have used treatment with chromatin remodeling drugs to reveal epigenetically silenced miRNAs.

In addition to their role in RNA silencing, miRNA can also activate translation (Posadas, D. M. & Carthew, R. W. *Curr Opin Genet Dev* 27, 1-6 (2014)). Knocking out these sites may lead to decreased expression of the targeted gene, while introducing these sites may increase expression.

Individual miRNAs can be knocked out most effectively by mutating the seed sequence (bases 2-8 of the microRNA), which is important for binding specificity. Cleavage in this region, followed by mis-repair by NHEJ can effectively abolish miRNA function by blocking binding to target sites. miRNA could also be inhibited by specific targeting of the special loop region adjacent to the palindromic sequence. Catalytically inactive Cas9 can also be used to inhibit shRNA expression (Zhao, Y. et al., *Sci Rep* 4, 3943 (2014)). In addition to targeting the miRNA, the binding sites can also be targeted and mutated to prevent the silencing by miRNA.

Chimeric Antigen Receptor (CAR) T Cells

A chimeric antigen receptor refers to an artificial immune cell receptor that is engineered to recognize and bind to an antigen expressed by tumor cells. Generally, a CAR is designed for a T cell and is a chimera of a signaling domain of the T-cell receptor (TcR) complex and an antigen-recognizing domain (e.g., a single chain fragment (scFv) of an antibody or other antibody fragment) (Enblad et al., Human Gene Therapy. 2015; 26(8):498-505). A T cell that expresses a CAR is referred to as a CAR T cell. CARs have the ability to redirect T-cell specificity and reactivity toward a selected target in a non-MHC-restricted manner. The non-MHC-restricted antigen recognition gives T-cells expressing CARs the ability to recognize an antigen independent of antigen processing, thus bypassing a major mechanism of tumor escape. Moreover, when expressed in T-cells, CARs advantageously do not dimerize with endogenous T-cell receptor (TCR) alpha and beta chains.

There are four generations of CARs, each of which contains different components. First generation CARs join an antibody-derived scFv to the CD3zeta (ζ or z) intracellular signaling domain of the T-cell receptor through hinge and transmembrane domains. Second generation CARs incorporate an additional domain, e.g., CD28, 4-1BB (41BB), or ICOS, to supply a costimulatory signal. Third-generation CARs contain two costimulatory domains fused with the TcR CD3-ζ chain. Third-generation costimulatory domains may include, e.g., a combination of CD3z, CD27, CD28, 4-1BB, ICOS, or OX40. CARs, in some embodiments, contain an ectodomain (e.g., CD3ζ), commonly derived from a single chain variable fragment (scFv), a hinge, a transmembrane domain, and an endodomain with one (first generation), two (second generation), or three (third generation) signaling domains derived from CD3Z and/or co-stimulatory molecules (Maude et al., *Blood*. 2015; 125(26):4017-4023; Kakarla and Gottschalk, *Cancer J.* 2014; 20(2):151-155).

CARs typically differ in their functional properties. The CD3ζ signaling domain of the T-cell receptor, when engaged, will activate and induce proliferation of T-cells but can lead to anergy (a lack of reaction by the body's defense mechanisms, resulting in direct induction of peripheral lymphocyte tolerance). Lymphocytes are considered anergic when they fail to respond to a specific antigen. The addition of a costimulatory domain in second-generation CARs improved replicative capacity and persistence of modified T-cells. Similar antitumor effects are observed in vitro with CD28 or 4-1BB CARs, but preclinical in vivo studies suggest that 4-1BB CARs may produce superior proliferation and/or persistence. Clinical trials suggest that both of these second-generation CARs are capable of inducing substantial T-cell proliferation in vivo, but CARs containing the 4-1BB costimulatory domain appear to persist longer. Third generation CARs combine multiple signaling domains (costimulatory) to augment potency.

In some embodiments, a chimeric antigen receptor is a first generation CAR. In other embodiments, a chimeric antigen receptor is a second generation CAR. In yet other embodiments, a chimeric antigen receptor is a third generation CAR.

A CAR, in some embodiments, comprises an extracellular (ecto) domain comprising an antigen binding domain (e.g., an antibody, such as an scFv), a transmembrane domain, and a cytoplasmic (endo) domain.

Ectodomain.

The ectodomain is the region of the CAR that is exposed to the extracellular fluid and, in some embodiments, includes an antigen binding domain, and optionally a signal peptide, a spacer domain, and/or a hinge domain. In some embodiments, the antigen binding domain is a single-chain variable fragment (scFv) that include the light and heavy chains of immunoglobins connected with a short linker peptide (e.g., any one of SEQ ID NO: 1591, 1594, or 1597). The linker, in some embodiments, includes hydrophilic residues with stretches of glycine and serine for flexibility as well as stretches of glutamate and lysine for added solubility. A single-chain variable fragment (scFv) is not actually a fragment of an antibody, but instead is a fusion protein of the variable regions of the heavy (VH) and light chains (VL) of immunoglobulins, connected with a short linker peptide of ten to about 25 amino acids. The linker is usually rich in glycine for flexibility, as well as serine or threonine for solubility, and can either connect the N-terminus of the VH with the C-terminus of the VL, or vice versa. This protein retains the specificity of the original immunoglobulin, despite removal of the constant regions and the introduction of the linker. In some embodiments, the scFv of the present disclosure is humanized. In other embodiments, the scFv is fully human. In yet other embodiments, the scFv is a chimera (e.g., of mouse and human sequence). In some embodiments, the scFv is an anti-CD70 scFv (binds specifically to CD70). Non-limiting examples of anti-CD70 scFv proteins and heavy and/or light chains that may be used as provided herein include those that comprise any one of SEQ ID NOs: 1499 (scFv), 1500 (scFV), 1592 (heavy chain), or 1593 (light chain).

The signal peptide can enhance the antigen specificity of CAR binding. Signal peptides can be derived from antibodies, such as, but not limited to, CD8, as well as epitope tags such as, but not limited to, GST or FLAG. Examples of signal peptides include MLLLVTSLLLCELPHPAFLLIP (SEQ ID NO: 1598) and MALPVTALLLPLALLLHAARP (SEQ ID NO: 1586). Other signal peptides may be used.

In some embodiments, a spacer domain or hinge domain is located between an extracellular domain (comprising the antigen binding domain) and a transmembrane domain of a CAR, or between a cytoplasmic domain and a transmembrane domain of the CAR. A spacer domain is any oligopeptide or polypeptide that functions to link the transmembrane domain to the extracellular domain and/or the cytoplasmic domain in the polypeptide chain. A hinge domain is any oligopeptide or polypeptide that functions to provide flexibility to the CAR, or domains thereof, or to prevent steric hindrance of the CAR, or domains thereof. In some embodiments, a spacer domain or a hinge domain may comprise up to 300 amino acids (e.g., 10 to 100 amino acids, or 5 to 20 amino acids). In some embodiments, one or more spacer domain(s) may be included in other regions of a CAR. In some embodiments, the hinge domain is a CD8 hinge domain. Other hinge domains may be used.

Transmembrane Domain.

The transmembrane domain is a hydrophobic alpha helix that spans the membrane. The transmembrane domain provides stability of the CAR. In some embodiments, the transmembrane domain of a CAR as provided herein is a CD8 transmembrane domain. In other embodiments, the transmembrane domain is a CD28 transmembrane domain. In yet other embodiments, the transmembrane domain is a chimera of a CD8 and CD28 transmembrane domain. Other transmembrane domains may be used as provided herein. In some embodiments, the transmembrane domain is a CD8a transmembrane domain, optionally including a 5' linker.

Endodomain.

The endodomain is the functional end of the receptor. Following antigen recognition, receptors cluster and a signal is transmitted to the cell. The most commonly used endodomain component is CD3-zeta, which contains three (3) ITAMs. This transmits an activation signal to the T cell after the antigen is bound. In many cases, CD3-zeta may not provide a fully competent activation signal and, thus, a co-stimulatory signaling is used. For example, CD28 and/or 4-1BB may be used with CD3-zeta (CD3ζ) to transmit a proliferative/survival signal. Thus, in some embodiments, the co-stimulatory molecule of a CAR as provided herein is a CD28 co-stimulatory molecule. In other embodiments, the co-stimulatory molecule is a 4-1BB co-stimulatory molecule. In some embodiments, a CAR includes CD3ζ and CD28. In other embodiments, a CAR includes CD3-zeta and 4-1BB. In still other embodiments, a CAR includes CD3ζ, CD28, and 4-1BB. Non-limiting examples of co-stimulatory molecules that may be used herein include those encoded by the nucleotide sequence of SEQ ID NO: 1377 (CD3-zeta), SEQ ID NO 1336 (CD28), and/or SEQ ID NO: 1339 (4-1BB).

Human Cells

As described and illustrated herein, the principal targets for gene editing are human cells. For example, primary human T cells, CD4+ and/or CD8+, can be edited. They can be isolated from peripheral blood mononuclear cell isolations.

Gene editing can be verified by alterations in target surface protein expression as well as analysis of DNA by PCR and/or sequencing.

Edited cells can have a selective advantage. MHC-I and/or MHC-II as well as PDCD1 or CTLA4 knockout T cells can persist longer in patients.

Edited cells can be assayed for off-target gene editing as well as translocations. They can also be tested for the ability to grow in cytokine free media. If edited cells display low off-target activity and minimal translocations, as well as have the inability to grow in cytokine free media, they will be deemed safe.

Primary human T cells can be isolated from peripheral blood mononuclear cells (PBMC) isolated from leukopaks. T cells can be expanded from PBMC by treatment with anti-CD3/CD28 antibody-coupled nanoparticles or beads. Activated T cells can be electroporated with RNP(s) containing Cas9 complexed to sgRNA. Cells can then be treated with AAV6 virus containing donor template DNA when HDR is needed, for example, for insertion of a nucleic acid encoding a CAR construct. Cells can then be expanded for 1-2 weeks in liquid culture. When TCR negative cells are required, edited cells can be selected for by antibody/column based methods, such as, for example, MACS.

By performing gene editing in allogeneic cells that are derived from a donor who does not have or is not suspected of having a medical condition to be treated, it is possible to generate cells that can be safely re-introduced into the patient, and effectively give rise to a population of cells that are effective in ameliorating one or more clinical conditions associated with the patient's disease.

By performing gene editing in autologous cells that are derived from and therefore already completely immunologically matched with the patient in need, it is possible to generate cells that can be safely re-introduced into the patient, and effectively give rise to a population of cells that are effective in ameliorating one or more clinical conditions associated with the patient's disease.

Progenitor cells (also referred to as stem cells herein) are capable of both proliferation and giving rise to more progenitor cells, these in turn having the ability to generate a large number of mother cells that can in turn give rise to differentiated or differentiable daughter cells. The daughter cells themselves can be induced to proliferate and produce progeny that subsequently differentiate into one or more mature cell types, while also retaining one or more cells with parental developmental potential. The term "stem cell" refers then, to a cell with the capacity or potential, under particular circumstances, to differentiate to a more specialized or differentiated phenotype, and which retains the capacity, under certain circumstances, to proliferate without substantially differentiating. In one aspect, the term progenitor or stem cell refers to a generalized mother cell whose descendants (progeny) specialize, often in different directions, by differentiation, e.g., by acquiring completely individual characters, as occurs in progressive diversification of embryonic cells and tissues. Cellular differentiation is a complex process typically occurring through many cell divisions. A differentiated cell may derive from a multipotent cell that itself is derived from a multipotent cell, and so on. While each of these multipotent cells may be considered stem cells, the range of cell types that each can give rise to may vary considerably. Some differentiated cells also have the capacity to give rise to cells of greater developmental potential. Such capacity may be natural or may be induced artificially upon treatment with various factors. In many biological instances, stem cells are also "multipotent" because they can produce progeny of more than one distinct cell type, but this is not required for "stem-ness."

Self-renewal is another important aspect of the stem cell. In theory, self-renewal can occur by either of two major mechanisms. Stem cells may divide asymmetrically, with one daughter retaining the stem state and the other daughter expressing some distinct other specific function and phenotype. Alternatively, some of the stem cells in a population can divide symmetrically into two stems, thus maintaining some stem cells in the population as a whole, while other cells in the population give rise to differentiated progeny only. Generally, "progenitor cells" have a cellular phenotype that is more primitive (i.e., is at an earlier step along a developmental pathway or progression than is a fully differentiated cell). Often, progenitor cells also have significant or very high proliferative potential. Progenitor cells can give rise to multiple distinct differentiated cell types or to a single differentiated cell type, depending on the developmental pathway and on the environment in which the cells develop and differentiate.

In the context of cell ontogeny, the adjective "differentiated," or "differentiating" is a relative term. A "differentiated cell" is a cell that has progressed further down the developmental pathway than the cell to which it is being compared. Thus, stem cells can differentiate into lineage-restricted precursor cells (such as a myocyte progenitor cell), which in turn can differentiate into other types of precursor cells further down the pathway (such as a myocyte precursor), and then to an end-stage differentiated cell, such as a myocyte, which plays a characteristic role in a certain tissue type, and may or may not retain the capacity to proliferate further.

The term "hematopoietic progenitor cell" refers to cells of a stem cell lineage that give rise to all the blood cell types, including erythroid (erythrocytes or red blood cells (RBCs)), myeloid (monocytes and macrophages, neutrophils, basophils, eosinophils, megakaryocytes/platelets, and dendritic cells), and lymphoid (T-cells, B-cells, NK-cells).

Isolating a Peripheral Blood Mononuclear Cell

Peripheral blood mononuclear cells may be isolated according to any method known in the art. For example, white blood cells may be isolated from a liquid sample by centrifugation and cell culturing.

Treating a Patient with GCSF

A patient may optionally be treated with granulocyte colony stimulating factor (GCSF) in accordance with any method known in the art. In some embodiments, the GCSF is administered in combination with Plerixaflor.

Animal Models

For efficacy studies, NOG or NSG mice can be used. They can be transplanted with human lymphoma cell lines and subsequently transplanted with edited human CAR-T cells. Loss/prevention of lymphoma cells can indicate the efficacy of edited T cells.

The safety of TCR edited T cells can be assessed in NOG or NSG mice. Human T cells transplanted into these mice can cause a lethal xenogeneic graft versus host disease (GVHD). Removal of the TCR by gene editing should alleviate this type of GVHD.

Genome Editing

Genome editing generally refers to the process of modifying the nucleotide sequence of a genome, preferably in a precise or pre-determined manner. Examples of methods of genome editing described herein include methods of using site-directed nucleases to cut deoxyribonucleic acid (DNA) at precise target locations in the genome, thereby creating single-strand or double-strand DNA breaks at particular locations within the genome. Such breaks may be and regularly are repaired by natural, endogenous cellular processes, such as homology-directed repair (HDR) and non-homologous end-joining (NHEJ), as recently reviewed in Cox et al., Nature Medicine 21(2), 121-31 (2015). These two main DNA repair processes consist of a family of alternative pathways. NHEJ directly joins the DNA ends resulting from a double-strand break, sometimes with the loss or addition of nucleotide sequence, which may disrupt or enhance gene expression. HDR utilizes a homologous sequence, or donor sequence, as a template for inserting a defined DNA sequence at the break point. The homologous sequence may be in the endogenous genome, such as a sister chromatid. Alternatively, the donor may be an exogenous nucleic acid, such as a plasmid, a single-strand oligonucleotide, a double-stranded oligonucleotide, a duplex oligonucleotide or a virus, that has regions of high homology with the nuclease-cleaved locus, but which may also contain additional sequence or sequence changes including deletions that may be incorporated into the cleaved target locus. A third repair mechanism is microhomology-mediated end joining (MMEJ), also referred to as "Alternative NHEJ", in which the genetic outcome is similar to NHEJ in that small deletions and insertions can occur at the cleavage site. MMEJ makes use of homologous sequences of a few basepairs flanking the DNA break site to drive a more favored DNA end joining repair outcome, and recent reports have further elucidated the molecular mechanism of this process; see, e.g., Cho and Greenberg, Nature 518, 174-76 (2015); Kent et al., Nature Structural and Molecular Biology, Adv. Online doi:10.1038/nsmb.2961(2015); Mateos-Gomez et al., Nature 518, 254-57 (2015); Ceccaldi et al., Nature 528, 258-62 (2015). In some instances, it may be possible to predict likely repair outcomes based on analysis of potential microhomologies at the site of the DNA break.

Each of these genome editing mechanisms can be used to create desired genomic alterations. A step in the genome editing process is to create one or two DNA breaks, the latter as double-strand breaks or as two single-stranded breaks, in the target locus as close as possible to the site of intended mutation. This can be achieved via the use of site-directed polypeptides, as described and illustrated herein.

Site-directed polypeptides, such as a DNA endonuclease, can introduce double-strand breaks or single-strand breaks in nucleic acids, e.g., genomic DNA. The double-strand break can stimulate a cell's endogenous DNA-repair pathways (e.g., homology-dependent repair or non-homologous end joining or alternative non-homologous end joining (A-NHEJ) or microhomology-mediated end joining). NHEJ can repair cleaved target nucleic acid without the need for a homologous template. This can sometimes result in small deletions or insertions (indels) in the target nucleic acid at the site of cleavage, and can lead to disruption or alteration of gene expression. HDR can occur when a homologous repair template, or donor, is available. The homologous donor template comprises sequences that are homologous to sequences flanking the target nucleic acid cleavage site. The sister chromatid is generally used by the cell as the repair template. However, for the purposes of genome editing, the repair template is often supplied as an exogenous nucleic acid, such as a plasmid, duplex oligonucleotide, single-strand oligonucleotide, double-stranded oligonucleotide, or viral nucleic acid. With exogenous donor templates, it is common to introduce an additional nucleic acid sequence (such as a transgene) or modification (such as a single or multiple base change or a deletion) between the flanking regions of homology so that the additional or altered nucleic acid sequence also becomes incorporated into the target locus. MMEJ results in a genetic outcome that is similar to NHEJ in that small deletions and insertions can occur at the cleavage site. MMEJ makes use of homologous sequences of a few basepairs flanking the cleavage site to drive a favored end-joining DNA repair outcome. In some instances, it may be possible to predict likely repair outcomes based on analysis of potential microhomologies in the nuclease target regions.

Thus, in some embodiments, either non-homologous end joining or homologous recombination is used to insert an exogenous polynucleotide sequence into the target nucleic acid cleavage site. An exogenous polynucleotide sequence is termed a donor polynucleotide (or donor or donor sequence or polynucleotide donor template) herein. In some embodiments, the donor polynucleotide, a portion of the donor polynucleotide, a copy of the donor polynucleotide, or a portion of a copy of the donor polynucleotide is inserted into the target nucleic acid cleavage site. In some embodiments, the donor polynucleotide is an exogenous polynucleotide sequence, i.e., a sequence that does not naturally occur at the target nucleic acid cleavage site.

The modifications of the target DNA due to NHEJ and/or HDR can lead to, for example, mutations, deletions, alterations, integrations, gene correction, gene replacement, gene tagging, transgene insertion, nucleotide deletion, gene disruption, translocations and/or gene mutation. The processes of deleting genomic DNA and integrating non-native nucleic acid into genomic DNA are examples of genome editing.

CRISPR Endonuclease System

A CRISPR (Clustered Regularly Interspaced Short Palindromic Repeats) genomic locus can be found in the genomes of many prokaryotes (e.g., bacteria and archaea). In prokaryotes, the CRISPR locus encodes products that function as a type of immune system to help defend the prokaryotes against foreign invaders, such as virus and phage. There are three stages of CRISPR locus function: integration of new sequences into the CRISPR locus, expression of CRISPR RNA (crRNA), and silencing of foreign invader nucleic acid. Five types of CRISPR systems (e.g., Type I, Type II, Type III, Type U, and Type V) have been identified.

A CRISPR locus includes a number of short repeating sequences referred to as "repeats." When expressed, the repeats can form secondary structures (e.g., hairpins) and/or comprise unstructured single-stranded sequences. The repeats usually occur in clusters and frequently diverge between species. The repeats are regularly interspaced with unique intervening sequences referred to as "spacers," resulting in a repeat-spacer-repeat locus architecture. The spacers are identical to or have high homology with known foreign invader sequences. A spacer-repeat unit encodes a crisprRNA (crRNA), which is processed into a mature form of the spacer-repeat unit. A crRNA comprises a "seed" or spacer sequence that is involved in targeting a target nucleic acid (in the naturally occurring form in prokaryotes, the spacer sequence targets the foreign invader nucleic acid). A spacer sequence is located at the 5' or 3' end of the crRNA.

A CRISPR locus also comprises polynucleotide sequences encoding CRISPR Associated (Cas) genes. Cas genes encode endonucleases involved in the biogenesis and the interference stages of crRNA function in prokaryotes. Some Cas genes comprise homologous secondary and/or tertiary structures.

Type II CRISPR Systems crRNA biogenesis in a Type II CRISPR system in nature requires a trans-activating CRISPR RNA (tracrRNA). The tracrRNA is modified by endogenous RNaseIII, and then hybridizes to a crRNA repeat in the pre-crRNA array. Endogenous RNaseIII is recruited to cleave the pre-crRNA. Cleaved crRNAs is subjected to exoribonuclease trimming to produce the mature crRNA form (e.g., 5' trimming). The tracrRNA remains hybridized to the crRNA, and the tracrRNA and the crRNA associate with a site-directed polypeptide (e.g., Cas9). The crRNA of the crRNA-tracrRNA-Cas9 complex guides the complex to a target nucleic acid to which the crRNA can hybridize. Hybridization of the crRNA to the target nucleic acid activates Cas9 for targeted nucleic acid cleavage. The target nucleic acid in a Type II CRISPR system is referred to as a protospacer adjacent motif (PAM). In nature, the PAM is essential to facilitate binding of a site-directed polypeptide (e.g., Cas9) to the target nucleic acid. Type II systems (also referred to as Nmeni or CASS4) are further subdivided into Type II-A (CASS4) and II-B (CASS4a). Jinek et al., Science, 337(6096):816-821 (2012) showed that the CRISPR/Cas9 system is useful for RNA-programmable genome editing, and international patent application publication number WO2013/176772 provides numerous examples and applications of the CRISPR/Cas endonuclease system for site-specific gene editing.

Type V CRISPR Systems

Type V CRISPR systems have several important differences from Type II systems. For example, Cpf1 is a single RNA-guided endonuclease that, in contrast to Type II systems, lacks tracrRNA. In fact, Cpf1-associated CRISPR arrays are processed into mature crRNAs without the requirement of an additional trans-activating tracrRNA. The Type V CRISPR array is processed into short mature crRNAs of 42-44 nucleotides in length, with each mature crRNA beginning with 19 nucleotides of direct repeat followed by 23-25 nucleotides of spacer sequence. In contrast, mature crRNAs in Type II systems start with 20-24 nucleotides of spacer sequence followed by about 22 nucleotides of direct repeat. Also, Cpf1 utilizes a T-rich protospacer-adjacent motif such that Cpf1-crRNA complexes efficiently cleave target DNA preceded by a short T-rich PAM, which is in contrast to the G-rich PAM following the target DNA for Type II systems. Thus, Type V systems cleave at a point that is distant from the PAM, while Type II systems cleave at a point that is adjacent to the PAM. In addition, in contrast to Type II systems, Cpf1 cleaves DNA via a staggered DNA double-stranded break with a 4 or 5 nucleotide 5' overhang. Type II systems cleave via a blunt double-stranded break. Similar to Type II systems, Cpf1 contains a predicted RuvC-like endonuclease domain, but lacks a second HNH endonuclease domain, which is in contrast to Type II systems.

Cas Genes/Polypeptides and Protospacer Adjacent Motifs

Figure 5A:
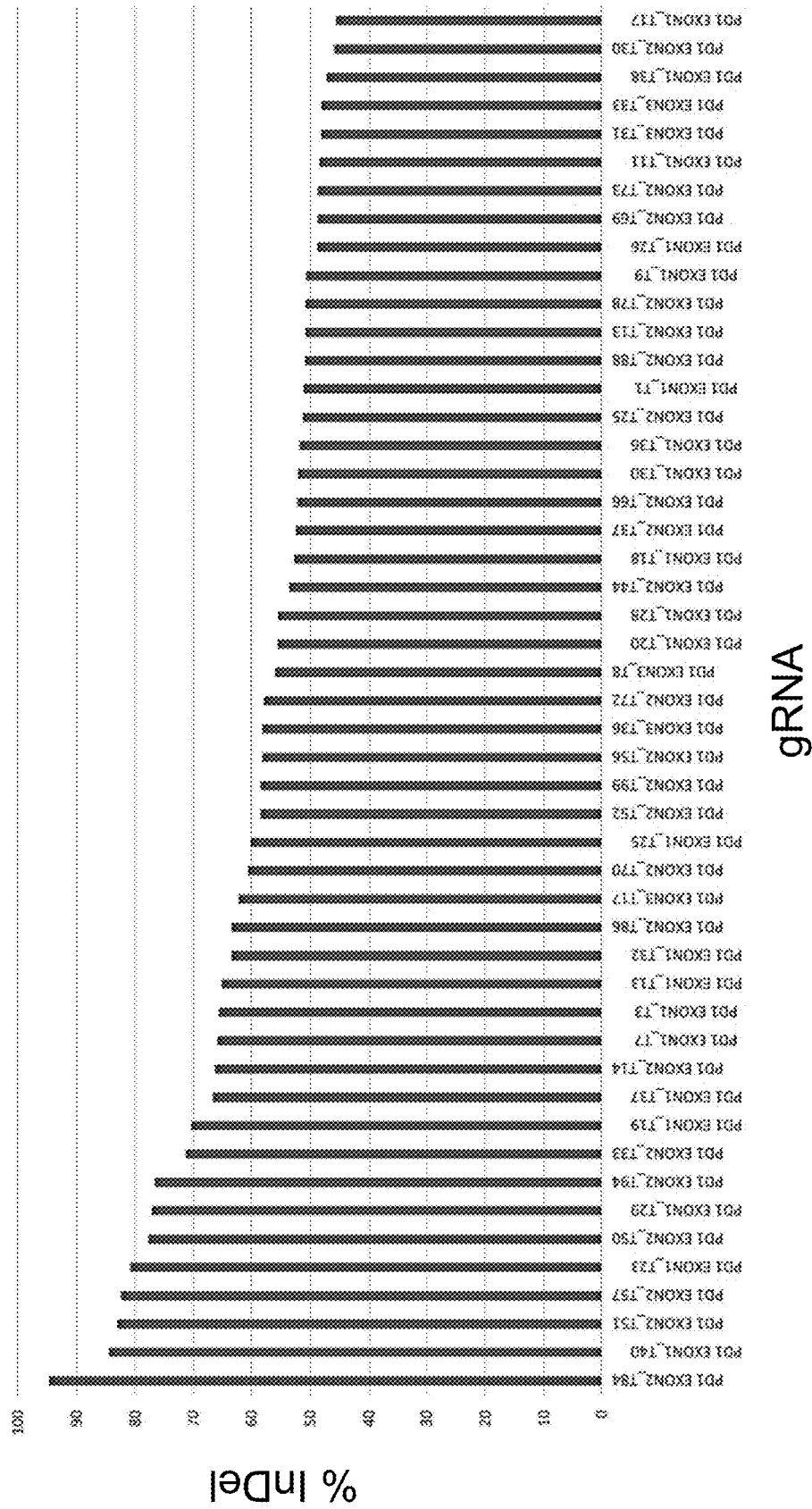
FIGS. 5A, 5B, and 5C are a series of graphs depicting a rank ordered list of IVT gRNAs targeting the PD1 gene and their respective activities (% InDel) in 293 cells.
Figure 5B:
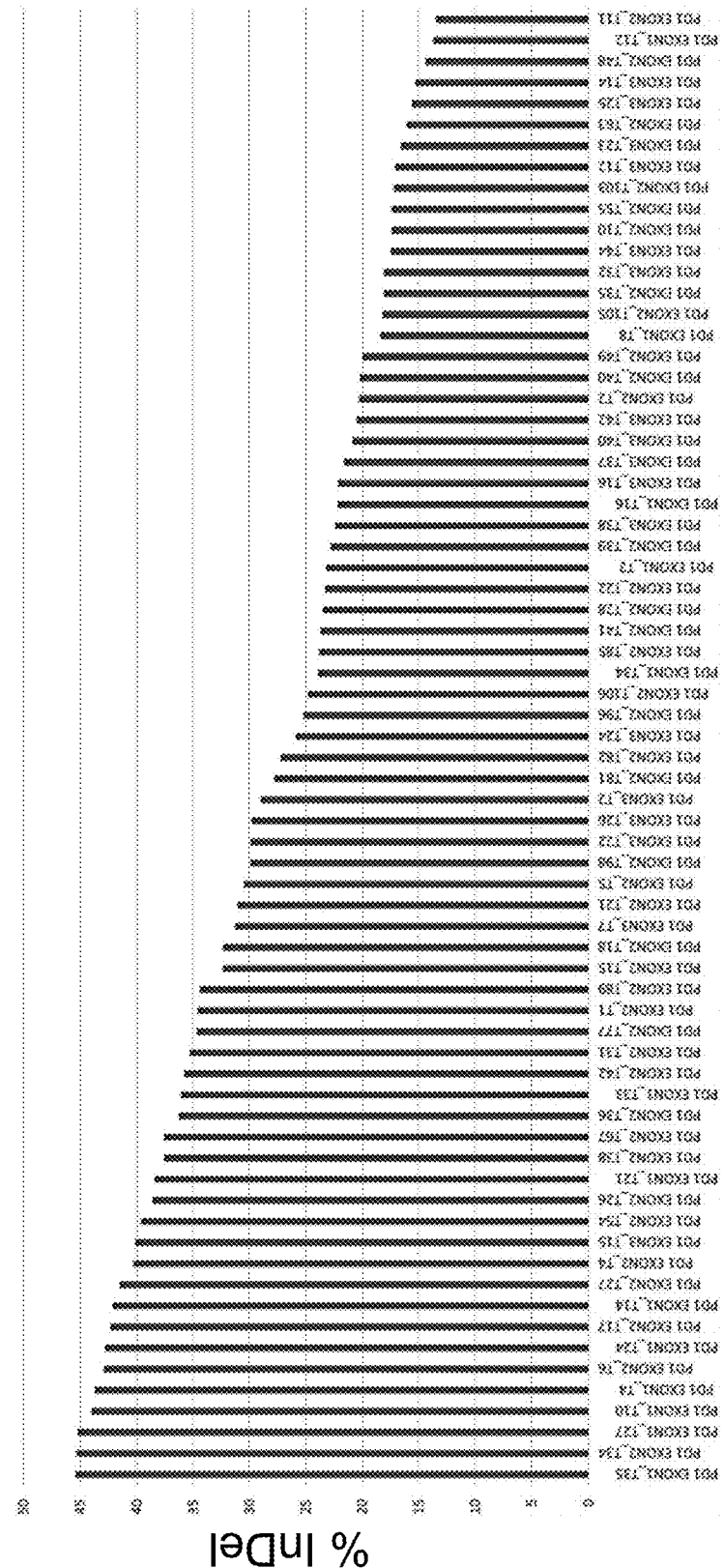
Figure 5C:
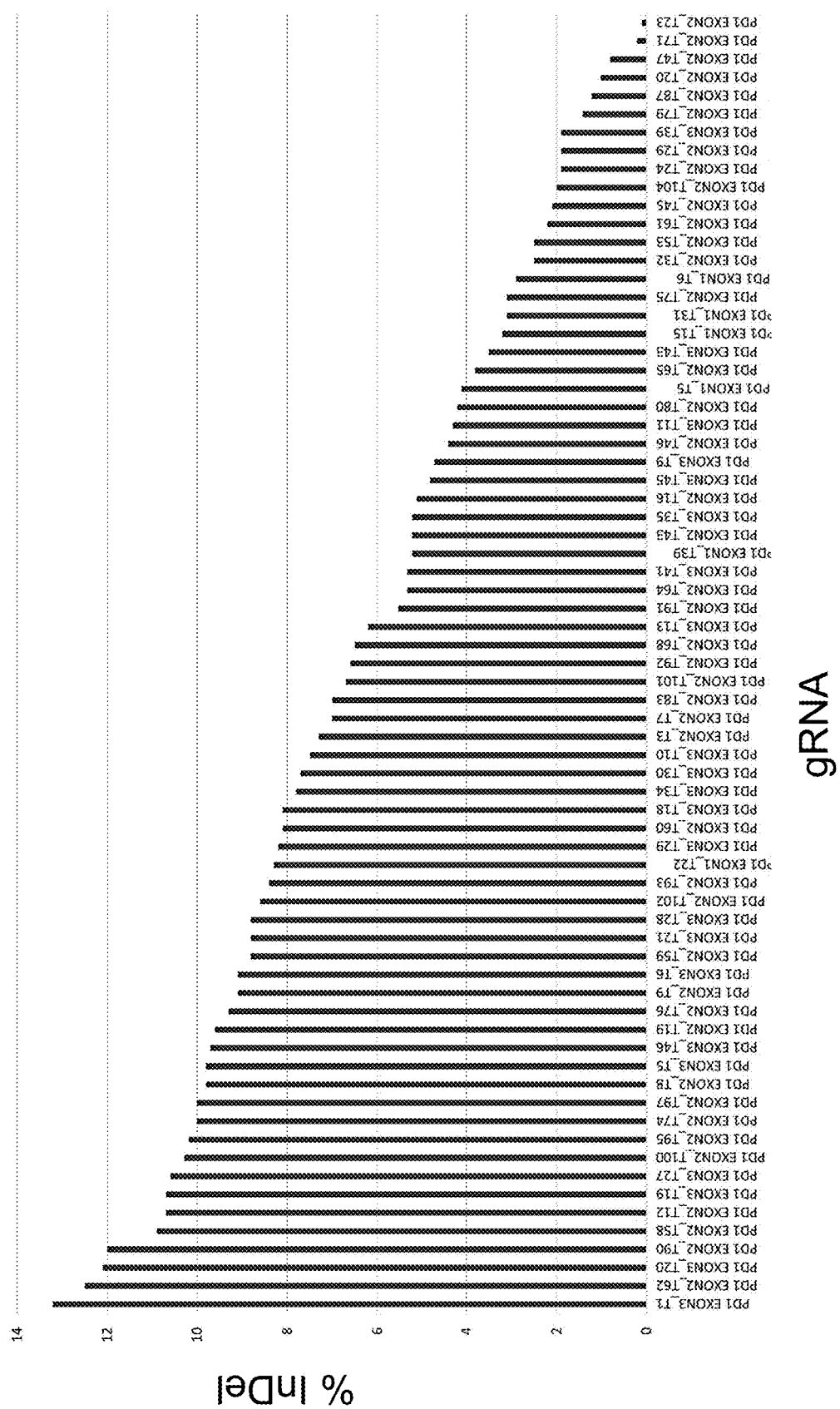

Exemplary CRISPR/Cas polypeptides include the Cas9 polypeptides in FIG. 1 of Fonfara et al., *Nucleic Acids Research*, 42: 2577-2590 (2014). The CRISPR/Cas gene naming system has undergone extensive rewriting since the Cas genes were discovered. FIG. 5 of Fonfara, supra, provides PAM sequences for the Cas9 polypeptides from various species.

Site-Directed Polypeptides

A site-directed polypeptide is a nuclease used in genome editing to cleave DNA. The site-directed may be administered to a cell or a patient as either: one or more polypeptides, or one or more mRNAs encoding the polypeptide.

In the context of a CRISPR/Cas or CRISPR/Cpf1 system, the site-directed polypeptide can bind to a guide RNA that, in turn, specifies the site in the target DNA to which the polypeptide is directed. In embodiments of the CRISPR/Cas or CRISPR/Cpf1 systems herein, the site-directed polypeptide is an endonuclease, such as a DNA endonuclease.

In some embodiments, a site-directed polypeptide comprises a plurality of nucleic acid-cleaving (i.e., nuclease) domains. Two or more nucleic acid-cleaving domains can be linked together via a linker. For example, the linker comprises a flexible linker. In some embodiments, linkers comprise 1, 2, 3, 4, 5, 6, 7, 8, 9, 10, 11, 12, 13, 14, 15, 16, 17, 18, 19, 20, 21, 22, 23, 24, 25, 30, 35, 40 or more amino acids in length.

Naturally-occurring wild-type Cas9 enzymes comprise two nuclease domains, a HNH nuclease domain and a RuvC domain. Herein, the "Cas9" refers to both naturally-occurring and recombinant Cas9s. Cas9 enzymes contemplated herein comprises a HNH or HNH-like nuclease domain, and/or a RuvC or RuvC-like nuclease domain.

HNH or HNH-like domains comprise a McrA-like fold. HNH or HNH-like domains comprises two antiparallel β-strands and an α-helix. HNH or HNH-like domains comprises a metal binding site (e.g., a divalent cation binding site). HNH or HNH-like domains can cleave one strand of a target nucleic acid (e.g., the complementary strand of the crRNA targeted strand).

RuvC or RuvC-like domains comprise an RNaseH or RNaseH-like fold. RuvC/RNaseH domains are involved in a diverse set of nucleic acid-based functions including acting on both RNA and DNA. The RNaseH domain comprises 5 β-strands surrounded by a plurality of α-helices. RuvC/RNaseH or RuvC/RNaseH-like domains comprise a metal binding site (e.g., a divalent cation binding site). RuvC/RNaseH or RuvC/RNaseH-like domains can cleave one strand of a target nucleic acid (e.g., the non-complementary strand of a double-stranded target DNA).

Site-directed polypeptides can introduce double-strand breaks or single-strand breaks in nucleic acids, e.g., genomic DNA. The double-strand break can stimulate a cell's endogenous DNA-repair pathways (e.g., homology-dependent repair (HDR) or non-homologous end-joining (NHEJ) or alternative non-homologous end joining (A-NHEJ) or microhomology-mediated end joining (MMEJ)). NHEJ can repair cleaved target nucleic acid without the need for a homologous template. This can sometimes result in small deletions or insertions (indels) in the target nucleic acid at the site of cleavage, and can lead to disruption or alteration of gene expression. HDR can occur when a homologous repair template, or donor, is available. The homologous donor template comprises sequences that are homologous to sequences flanking the target nucleic acid cleavage site. The sister chromatid is generally used by the cell as the repair template. However, for the purposes of genome editing, the repair template is often supplied as an exogenous nucleic acid, such as a plasmid, duplex oligonucleotide, single-strand oligonucleotide or viral nucleic acid. With exogenous donor templates, it is common to introduce an additional nucleic acid sequence (such as a transgene) or modification (such as a single or multiple base change or a deletion) between the flanking regions of homology so that the additional or altered nucleic acid sequence also becomes incorporated into the target locus. MMEJ results in a genetic outcome that is similar to NHEJ in that small deletions and insertions can occur at the cleavage site. MMEJ makes use of homologous sequences of a few basepairs flanking the cleavage site to drive a favored end-joining DNA repair outcome. In some instances, it may be possible to predict likely repair outcomes based on analysis of potential microhomologies in the nuclease target regions.

Thus, in some embodiments, homologous recombination is used to insert an exogenous polynucleotide sequence into the target nucleic acid cleavage site. An exogenous polynucleotide sequence is termed a donor polynucleotide (or donor or donor sequence) herein. In some embodiments, the donor polynucleotide, a portion of the donor polynucleotide, a copy of the donor polynucleotide, or a portion of a copy of the donor polynucleotide is inserted into the target nucleic acid cleavage site. In some embodiments, the donor polynucleotide is an exogenous polynucleotide sequence, i.e., a sequence that does not naturally occur at the target nucleic acid cleavage site.

The modifications of the target DNA due to NHEJ and/or HDR can lead to, for example, mutations, deletions, alterations, integrations, gene correction, gene replacement, gene tagging, transgene insertion, nucleotide deletion, gene disruption, translocations and/or gene mutation. The processes of deleting genomic DNA and integrating non-native nucleic acid into genomic DNA are examples of genome editing.

In some embodiments, the site-directed polypeptide comprises an amino acid sequence having at least 10%, at least 15%, at least 20%, at least 30%, at least 40%, at least 50%, at least 60%, at least 70%, at least 75%, at least 80%, at least 85%, at least 90%, at least 95%, at least 99%, or 100% amino acid sequence identity to a wild-type exemplary site-directed polypeptide [e.g., Cas9 from S. pyogenes, US2014/0068797 Sequence ID No. 8 or Sapranauskas et al., Nucleic Acids Res, 39(21): 9275-9282 (2011], and various other site-directed polypeptides. In some embodiments, the site-directed polypeptide comprises at least 70, 75, 80, 85, 90, 95, 97, 99, or 100% identity to a wild-type site-directed polypeptide (e.g., Cas9 from S. pyogenes, supra) over 10 contiguous amino acids.

In some embodiments, the site-directed polypeptide comprises an amino acid sequence having at least 10%, at least 15%, at least 20%, at least 30%, at least 40%, at least 50%, at least 60%, at least 70%, at least 75%, at least 80%, at least 85%, at least 90%, at least 95%, at least 99%, or 100% amino acid sequence identity to the nuclease domain of a wild-type exemplary site-directed polypeptide (e.g., Cas9 from S. pyogenes, supra).

In some embodiments, the site-directed polypeptide comprises at most: 70, 75, 80, 85, 90, 95, 97, 99, or 100% identity to a wild-type site-directed polypeptide (e.g., Cas9 from S. pyogenes, supra) over 10 contiguous amino acids. In some embodiments, the site-directed polypeptide comprises at least: 70, 75, 80, 85, 90, 95, 97, 99, or 100% identity to a wild-type site-directed polypeptide (e.g., Cas9 from S. pyogenes, supra) over 10 contiguous amino acids in a HNH nuclease domain of the site-directed polypeptide. In some embodiments, the site-directed polypeptide comprises at most: 70, 75, 80, 85, 90, 95, 97, 99, or 100% identity to a wild-type site-directed polypeptide (e.g., Cas9 from S. pyogenes, supra) over 10 contiguous amino acids in a HNH nuclease domain of the site-directed polypeptide. In some embodiments, the site-directed polypeptide comprises at least: 70, 75, 80, 85, 90, 95, 97, 99, or 100% identity to a wild-type site-directed polypeptide (e.g., Cas9 from S. pyogenes, supra) over 10 contiguous amino acids in a RuvC nuclease domain of the site-directed polypeptide. In some embodiments, the site-directed polypeptide comprises at most: 70, 75, 80, 85, 90, 95, 97, 99, or 100% identity to a wild-type site-directed polypeptide (e.g., Cas9 from *S. pyogenes*, supra) over 10 contiguous amino acids in a RuvC nuclease domain of the site-directed polypeptide.

In some embodiments, the site-directed polypeptide comprises a modified form of a wild-type exemplary site-directed polypeptide. In some embodiments, the modified form of the wild-type exemplary site-directed polypeptide comprises a mutation that reduces the nucleic acid-cleaving activity of the site-directed polypeptide. In some embodiments, the modified form of the wild-type exemplary site-directed polypeptide has less than 90%, less than 80%, less than 70%, less than 60%, less than 50%, less than 40%, less than 30%, less than 20%, less than 10%, less than 5%, or less than 1% of the nucleic acid-cleaving activity of the wild-type exemplary site-directed polypeptide (e.g., Cas9 from *S. pyogenes*, supra). In some embodiments, the modified form of the site-directed polypeptide has no substantial nucleic acid-cleaving activity. When a site-directed polypeptide is a modified form that has no substantial nucleic acid-cleaving activity, it is referred to herein as "enzymatically inactive."

In some embodiments, the modified form of the site-directed polypeptide comprises a mutation such that it can induce a single-strand break (SSB) on a target nucleic acid (e.g., by cutting only one of the sugar-phosphate backbones of a double-strand target nucleic acid). In some embodiments, the mutation results in less than 90%, less than 80%, less than 70%, less than 60%, less than 50%, less than 40%, less than 30%, less than 20%, less than 10%, less than 5%, or less than 1% of the nucleic acid-cleaving activity in one or more of the plurality of nucleic acid-cleaving domains of the wild-type site directed polypeptide (e.g., Cas9 from *S. pyogenes*, supra). In some embodiments, the mutation results in one or more of the plurality of nucleic acid-cleaving domains retaining the ability to cleave the complementary strand of the target nucleic acid, but reducing its ability to cleave the non-complementary strand of the target nucleic acid. In some embodiments, the mutation results in one or more of the plurality of nucleic acid-cleaving domains retaining the ability to cleave the non-complementary strand of the target nucleic acid, but reducing its ability to cleave the complementary strand of the target nucleic acid. For example, residues in the wild-type exemplary *S. pyogenes* Cas9 polypeptide, such as Asp10, His840, Asn854 and Asn856, are mutated to inactivate one or more of the plurality of nucleic acid-cleaving domains (e.g., nuclease domains). The residues to be mutated can correspond to residues Asp10, His840, Asn854 and Asn856 in the wild-type exemplary *S. pyogenes* Cas9 polypeptide (e.g., as determined by sequence and/or structural alignment). Non-limiting examples of mutations include D10A, H840A, N854A or N856A. One skilled in the art will recognize that mutations other than alanine substitutions can be suitable.

In some embodiments, a D10A mutation is combined with one or more of H840A, N854A, or N856A mutations to produce a site-directed polypeptide substantially lacking DNA cleavage activity. In some embodiments, a H840A mutation is combined with one or more of D10A, N854A, or N856A mutations to produce a site-directed polypeptide substantially lacking DNA cleavage activity. In some embodiments, a N854A mutation is combined with one or more of H840A, D10A, or N856A mutations to produce a site-directed polypeptide substantially lacking DNA cleavage activity. In some embodiments, aN856A mutation is combined with one or more of H840A, N854A, or D10A mutations to produce a site-directed polypeptide substantially lacking DNA cleavage activity. Site-directed polypeptides that comprise one substantially inactive nuclease domain are referred to as "nickases".

Nickase variants of RNA-guided endonucleases, for example Cas9, can be used to increase the specificity of CRISPR-mediated genome editing. Wild type Cas9 is typically guided by a single guide RNA designed to hybridize with a specified ~20 nucleotide sequence in the target sequence (such as an endogenous genomic locus). However, several mismatches can be tolerated between the guide RNA and the target locus, effectively reducing the length of required homology in the target site to, for example, as little as 13 nt of homology, and thereby resulting in elevated potential for binding and double-strand nucleic acid cleavage by the CRISPR/Cas9 complex elsewhere in the target genome—also known as off-target cleavage. Because nickase variants of Cas9 each only cut one strand, in order to create a double-strand break it is necessary for a pair of nickases to bind in close proximity and on opposite strands of the target nucleic acid, thereby creating a pair of nicks, which is the equivalent of a double-strand break. This requires that two separate guide RNAs—one for each nickase—must bind in close proximity and on opposite strands of the target nucleic acid. This requirement essentially doubles the minimum length of homology needed for the double-strand break to occur, thereby reducing the likelihood that a double-strand cleavage event will occur elsewhere in the genome, where the two guide RNA sites—if they exist—are unlikely to be sufficiently close to each other to enable the double-strand break to form. As described in the art, nickases can also be used to promote HDR versus NHEJ. HDR can be used to introduce selected changes into target sites in the genome through the use of specific donor sequences that effectively mediate the desired changes. Descriptions of various CRISPR/Cas systems for use in gene editing can be found, e.g., in international patent application publication number WO2013/176772, and in *Nature Biotechnology* 32, 347-355 (2014), and references cited therein.

Mutations contemplated include substitutions, additions, and deletions, or any combination thereof. In some embodiments, the mutation converts the mutated amino acid to alanine. In some embodiments, the mutation converts the mutated amino acid to another amino acid (e.g., glycine, serine, threonine, cysteine, valine, leucine, isoleucine, methionine, proline, phenylalanine, tyrosine, tryptophan, aspartic acid, glutamic acid, asparagines, glutamine, histidine, lysine, or arginine). In some embodiments, the mutation converts the mutated amino acid to a non-natural amino acid (e.g., selenomethionine). In some embodiments, the mutation converts the mutated amino acid to amino acid mimics (e.g., phosphomimics). In some embodiments, the mutation is a conservative mutation. For example, the mutation converts the mutated amino acid to amino acids that resemble the size, shape, charge, polarity, conformation, and/or rotamers of the mutated amino acids (e.g., cysteine/serine mutation, lysine/asparagine mutation, histidine/phenylalanine mutation). In some embodiments, the mutation causes a shift in reading frame and/or the creation of a premature stop codon. In some embodiments, mutations cause changes to regulatory regions of genes or loci that affect expression of one or more genes.

In some embodiments, the site-directed polypeptide (e.g., variant, mutated, enzymatically inactive and/or conditionally enzymatically inactive site-directed polypeptide) targets nucleic acid. In some embodiments, the site-directed polypeptide (e.g., variant, mutated, enzymatically inactive and/or conditionally enzymatically inactive endoribonuclease) targets DNA. In some embodiments, the site-directed polypeptide (e.g., variant, mutated, enzymatically inactive and/or conditionally enzymatically inactive endoribonuclease) targets RNA.

In some embodiments, the site-directed polypeptide comprises one or more non-native sequences (e.g., the site-directed polypeptide is a fusion protein).

In some embodiments, the site-directed polypeptide comprises an amino acid sequence comprising at least 15% amino acid identity to a Cas9 from a bacterium (e.g., *S. pyogenes*), a nucleic acid binding domain, and two nucleic acid cleaving domains (i.e., a HNH domain and a RuvC domain).

In some embodiments, the site-directed polypeptide comprises an amino acid sequence comprising at least 15% amino acid identity to a Cas9 from a bacterium (e.g., *S. pyogenes*), and two nucleic acid cleaving domains (i.e., a HNH domain and a RuvC domain).

In some embodiments, the site-directed polypeptide comprises an amino acid sequence comprising at least 15% amino acid identity to a Cas9 from a bacterium (e.g., *S. pyogenes*), and two nucleic acid cleaving domains, wherein one or both of the nucleic acid cleaving domains comprise at least 50% amino acid identity to a nuclease domain from Cas9 from a bacterium (e.g., *S. pyogenes*).

In some embodiments, the site-directed polypeptide comprises an amino acid sequence comprising at least 15% amino acid identity to a Cas9 from a bacterium (e.g., *S. pyogenes*), two nucleic acid cleaving domains (i.e., a HNH domain and a RuvC domain), and non-native sequence (for example, a nuclear localization signal) or a linker linking the site-directed polypeptide to a non-native sequence.

In some embodiments, the site-directed polypeptide comprises an amino acid sequence comprising at least 15% amino acid identity to a Cas9 from a bacterium (e.g., *S. pyogenes*), two nucleic acid cleaving domains (i.e., a HNH domain and a RuvC domain), wherein the site-directed polypeptide comprises a mutation in one or both of the nucleic acid cleaving domains that reduces the cleaving activity of the nuclease domains by at least 50%.

In some embodiments, the site-directed polypeptide comprises an amino acid sequence comprising at least 15% amino acid identity to a Cas9 from a bacterium (e.g., *S. pyogenes*), and two nucleic acid cleaving domains (i.e., a HNH domain and a RuvC domain), wherein one of the nuclease domains comprises mutation of aspartic acid 10, and/or wherein one of the nuclease domains comprises a mutation of histidine 840, and wherein the mutation reduces the cleaving activity of the nuclease domain(s) by at least 50%.

In some embodiments, the one or more site-directed polypeptides, e.g. DNA endonucleases, comprises two nickases that together effect one double-strand break at a specific locus in the genome, or four nickases that together effect or cause two double-strand breaks at specific loci in the genome. Alternatively, one site-directed polypeptide, e.g. DNA endonuclease, effects one double-strand break at a specific locus in the genome.

Genome-Targeting Nucleic Acid

The present disclosure provides a genome-targeting nucleic acid that can direct the activities of an associated polypeptide (e.g., a site-directed polypeptide) to a specific target sequence within a target nucleic acid. The genome-targeting nucleic acid can be an RNA. A genome-targeting RNA is referred to as a "guide RNA" or "gRNA" herein. A guide RNA comprises at least a spacer sequence that hybridizes to a target nucleic acid sequence of interest, and a CRISPR repeat sequence. In Type II systems, the gRNA also comprises a second RNA called the tracrRNA sequence. In the Type II guide RNA (gRNA), the CRISPR repeat sequence and tracrRNA sequence hybridize to each other to form a duplex. In the Type V guide RNA (gRNA), the crRNA forms a duplex. In both systems, the duplex binds a site-directed polypeptide, such that the guide RNA and site-direct polypeptide form a complex. In some embodiments, the genome-targeting nucleic acid provides target specificity to the complex by virtue of its association with the site-directed polypeptide. The genome-targeting nucleic acid thus directs the activity of the site-directed polypeptide.

Exemplary guide RNAs include the spacer sequences in SEQ ID NOs: 83-158, 284-408, 458-506, 699-890, 1083-1276, 1288-1298, and 1308-1312 with the genome location of their target sequence and the associated endonuclease (e.g., Cas9) cut site. As is understood by the person of ordinary skill in the art, each guide RNA is designed to include a spacer sequence complementary to its genomic target sequence. For example, each of the spacer sequences in SEQ ID NOs: 83-158, 284-408, 458-506, 699-890, 1083-1276, 1288-1298, and 1308-1312 can be put into a single RNA chimera or a crRNA (along with a corresponding tracrRNA). See Jinek et al., Science, 337, 816-821 (2012) and Deltcheva et al., Nature, 471, 602-607 (2011).

In some embodiments, the genome-targeting nucleic acid is a double-molecule guide RNA. In some embodiments, the genome-targeting nucleic acid is a single-molecule guide RNA.

A double-molecule guide RNA comprises two strands of RNA. The first strand comprises in the 5' to 3' direction, an optional spacer extension sequence, a spacer sequence and a minimum CRISPR repeat sequence. The second strand comprises a minimum tracrRNA sequence (complementary to the minimum CRISPR repeat sequence), a 3' tracrRNA sequence and an optional tracrRNA extension sequence.

A single-molecule guide RNA (sgRNA) in a Type II system comprises, in the 5' to 3' direction, an optional spacer extension sequence, a spacer sequence, a minimum CRISPR repeat sequence, a single-molecule guide linker, a minimum tracrRNA sequence, a 3' tracrRNA sequence and an optional tracrRNA extension sequence. The optional tracrRNA extension may comprise elements that contribute additional functionality (e.g., stability) to the guide RNA. The single-molecule guide linker links the minimum CRISPR repeat and the minimum tracrRNA sequence to form a hairpin structure. The optional tracrRNA extension comprises one or more hairpins.

A single-molecule guide RNA (sgRNA) in a Type V system comprises, in the 5' to 3' direction, a minimum CRISPR repeat sequence and a spacer sequence.

The sgRNA can comprise a 20 nucleotide spacer sequence at the 5' end of the sgRNA sequence. The sgRNA can comprise a less than a 20 nucleotide spacer sequence at the 5' end of the sgRNA sequence. The sgRNA can comprise a more than 20 nucleotide spacer sequence at the 5' end of the sgRNA sequence. The sgRNA can comprise a variable length spacer sequence with 17-30 nucleotides at the 5' end of the sgRNA sequence (see Table 1).

The sgRNA can comprise no uracil at the 3' end of the sgRNA sequence, such as in SEQ ID NO: 1 of Table 1. The sgRNA can comprise one or more uracil at the 3' end of the sgRNA sequence, such as in SEQ ID NOs: 1, 2, or 3 in Table 1. For example, the sgRNA can comprise 1 uracil (U) at the 3' end of the sgRNA sequence. The sgRNA can comprise 2 uracil (UU) at the 3' end of the sgRNA sequence. The sgRNA can comprise 3 uracil (UUU) at the 3' end of the sgRNA sequence. The sgRNA can comprise 4 uracil (UUUU) at the 3' end of the sgRNA sequence. The sgRNA can comprise 5 uracil (UUUUU) at the 3' end of the sgRNA sequence. The sgRNA can comprise 6 uracil (UUUUUU) at the 3' end of the sgRNA sequence. The sgRNA can comprise 7 uracil (UUUUUUU) at the 3' end of the sgRNA sequence. The sgRNA can comprise 8 uracil (UUUUUUUU) at the 3' end of the sgRNA sequence.

The sgRNA can be unmodified or modified. For example, modified sgRNAs can comprise one or more 2'-O-methyl phosphorothioate nucleotides.

some embodiments, the moiety decreases or increases the stability of a nucleic acid targeting nucleic acid. In some embodiments, the moiety is a transcriptional terminator segment (i.e., a transcription termination sequence). In some embodiments, the moiety functions in a eukaryotic cell. In some embodiments, the moiety functions in a prokaryotic cell. In some embodiments, the moiety functions in both eukaryotic and prokaryotic cells. Non-limiting examples of suitable moieties include: a 5' cap (e.g., a 7-methylguanylate cap (m7 G)), a riboswitch sequence (e.g., to allow for regulated stability and/or regulated accessibility by proteins and protein complexes), a sequence that forms a dsRNA

TABLE 1

| SEQ ID NO. | sgRNA sequence |
|---|---|
| 1 | nnnnnnnnnnnnnnnnnnnnguuuuagagcuagaaauagcaaguuaaaauaaggcuaguccg uuaucaacuugaaaaaguggcaccgagucggugcuuuu |
| 2 | nnnnnnnnnnnnnnnnnnnnguuuuagagcuagaaauagcaaguuaaaauaaggcuaguccg uuaucaacuugaaaaaguggcaccgagucggugc |
| 3 | n(17-30)guuuuagagcuagaaauag caaguuaaaauaaggcuaguccguuaucaacuugaaaaagu ggcaccgagucggugcu(1-8) |

By way of illustration, guide RNAs used in the CRISPR/Cas/Cpf1 system, or other smaller RNAs can be readily synthesized by chemical means, as illustrated below and described in the art. While chemical synthetic procedures are continually expanding, purifications of such RNAs by procedures such as high performance liquid chromatography (HPLC, which avoids the use of gels such as PAGE) tends to become more challenging as polynucleotide lengths increase significantly beyond a hundred or so nucleotides. One approach used for generating RNAs of greater length is to produce two or more molecules that are ligated together. Much longer RNAs, such as those encoding a Cas9 or Cpf1 endonuclease, are more readily generated enzymatically. Various types of RNA modifications can be introduced during or after chemical synthesis and/or enzymatic generation of RNAs, e.g., modifications that enhance stability, reduce the likelihood or degree of innate immune response, and/or enhance other attributes, as described in the art.

Spacer Extension Sequence

In some examples of genome-targeting nucleic acids, a spacer extension sequence may modify activity, provide stability and/or provide a location for modifications of a genome-targeting nucleic acid. A spacer extension sequence may modify on- or off-target activity or specificity. In some embodiments, a spacer extension sequence is provided. A spacer extension sequence may have a length of more than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400, 1000, 2000, 3000, 4000, 5000, 6000, or 7000 or more nucleotides. The spacer extension sequence may have a length of less than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400, 1000, 2000, 3000, 4000, 5000, 6000, 7000 or more nucleotides. In some embodiments, the spacer extension sequence is less than 10 nucleotides in length. In some embodiments, the spacer extension sequence is between 10-30 nucleotides in length. In some embodiments, the spacer extension sequence is between 30-70 nucleotides in length.

In some embodiments, the spacer extension sequence comprises another moiety (e.g., a stability control sequence, an endoribonuclease binding sequence, a ribozyme). In duplex (i.e., a hairpin), a sequence that targets the RNA to a subcellular location (e.g., nucleus, mitochondria, chloroplasts, and the like), a modification or sequence that provides for tracking (e.g., direct conjugation to a fluorescent molecule, conjugation to a moiety that facilitates fluorescent detection, a sequence that allows for fluorescent detection, etc.), and/or a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like).

Spacer Sequence

A gRNA comprises a spacer sequence. A spacer sequence is a sequence (e.g., a 20 base pair sequence) that defines the target sequence (e.g., a DNA target sequences, such as a genomic target sequence) of a target nucleic acid of interest. The "target sequence" is adjacent to a PAM sequence and is the sequence modified by an RNA-guided nuclease (e.g., Cas9). The "target nucleic acid" is a double-stranded molecule: one strand comprises the target sequence and is referred to as the "PAM strand," and the other complementary strand is referred to as the "non-PAM strand." One of skill in the art recognizes that the gRNA spacer sequence hybridizes to the reverse complement of the target sequence, which is located in the non-PAM strand of the target nucleic acid of interest. Thus, the gRNA spacer sequence is the RNA equivalent of the target sequence. For example, if the target sequence is 5'-AGAGCAACAGTGCTGTGGCC-3' (SEQ ID NO: 76), then the gRNA spacer sequence is 5'-AGAG-CAACAGUGCUGUGGCC-3' (SEQ ID NO: 152). The spacer of a gRNA interacts with a target nucleic acid of interest in a sequence-specific manner via hybridization (i.e., base pairing). The nucleotide sequence of the spacer thus varies depending on the target sequence of the target nucleic acid of interest.

In a CRISPR/Cas system herein, the spacer sequence is designed to hybridize to a region of the target nucleic acid that is located 5' of a PAM of the Cas9 enzyme used in the system. The spacer may perfectly match the target sequence or may have mismatches. Each Cas9 enzyme has a particular PAM sequence that it recognizes in a target DNA. For example, S. pyogenes recognizes in a target nucleic acid a PAM that comprises the sequence 5'-NRG-3', where R comprises either A or G, where N is any nucleotide and N is immediately 3' of the target nucleic acid sequence targeted by the spacer sequence.

In some embodiments, the target nucleic acid sequence comprises 20 nucleotides. In some embodiments, the target nucleic acid comprises less than 20 nucleotides. In some embodiments, the target nucleic acid comprises more than 20 nucleotides. In some embodiments, the target nucleic acid comprises at least: 5, 10, 15, 16, 17, 18, 19, 20, 21, 22, 23, 24, 25, 30 or more nucleotides. In some embodiments, the target nucleic acid comprises at most: 5, 10, 15, 16, 17, 18, 19, 20, 21, 22, 23, 24, 25, 30 or more nucleotides. In some embodiments, the target nucleic acid sequence comprises 20 bases immediately 5' of the first nucleotide of the PAM. For example, in a sequence comprising 5'-NNNNNNNNNNNNNNNNNNNNNRG-3', the target nucleic acid comprises the sequence that corresponds to the Ns, wherein N is any nucleotide, and the underlined NRG sequence is the S. pyogenes PAM.

In some embodiments, the spacer sequence that hybridizes to the target nucleic acid has a length of at least about 6 nucleotides (nt). The spacer sequence can be at least about 6 nt, at least about 10 nt, at least about 15 nt, at least about 18 nt, at least about 19 nt, at least about 20 nt, at least about 25 nt, at least about 30 nt, at least about 35 nt or at least about 40 nt, from about 6 nt to about 80 nt, from about 6 nt to about 50 nt, from about 6 nt to about 45 nt, from about 6 nt to about 40 nt, from about 6 nt to about 35 nt, from about 6 nt to about 30 nt, from about 6 nt to about 25 nt, from about 6 nt to about 20 nt, from about 6 nt to about 19 nt, from about 10 nt to about 50 nt, from about 10 nt to about 45 nt, from about 10 nt to about 40 nt, from about 10 nt to about 35 nt, from about 10 nt to about 30 nt, from about 10 nt to about 25 nt, from about 10 nt to about 20 nt, from about 10 nt to about 19 nt, from about 19 nt to about 25 nt, from about 19 nt to about 30 nt, from about 19 nt to about 35 nt, from about 19 nt to about 40 nt, from about 19 nt to about 45 nt, from about 19 nt to about 50 nt, from about 19 nt to about 60 nt, from about 20 nt to about 25 nt, from about 20 nt to about 30 nt, from about 20 nt to about 35 nt, from about 20 nt to about 40 nt, from about 20 nt to about 45 nt, from about 20 nt to about 50 nt, or from about 20 nt to about 60 nt. In some embodiments, the spacer sequence comprises 20 nucleotides. In some embodiments, the spacer comprises 19 nucleotides.

In some embodiments, the percent complementarity between the spacer sequence and the target nucleic acid is at least about 30%, at least about 40%, at least about 50%, at least about 60%, at least about 65%, at least about 70%, at least about 75%, at least about 80%, at least about 85%, at least about 90%, at least about 95%, at least about 97%, at least about 98%, at least about 99%, or 100%. In some embodiments, the percent complementarity between the spacer sequence and the target nucleic acid is at most about 30%, at most about 40%, at most about 50%, at most about 60%, at most about 65%, at most about 70%, at most about 75%, at most about 80%, at most about 85%, at most about 90%, at most about 95%, at most about 97%, at most about 98%, at most about 99%, or 100%. In some embodiments, the percent complementarity between the spacer sequence and the target nucleic acid is 100% over the six contiguous 5'-most nucleotides of the target sequence of the complementary strand of the target nucleic acid. In some embodiments, the percent complementarity between the spacer sequence and the target nucleic acid is at least 60% over about 20 contiguous nucleotides. In some embodiments, the length of the spacer sequence and the target nucleic acid differs by 1 to 6 nucleotides, which may be thought of as a bulge or bulges.

In some embodiments, the spacer sequence can be designed using a computer program. The computer program can use variables, such as predicted melting temperature, secondary structure formation, predicted annealing temperature, sequence identity, genomic context, chromatin accessibility, % GC, frequency of genomic occurrence (e.g., of sequences that are identical or are similar but vary in one or more spots as a result of mismatch, insertion or deletion), methylation status, presence of SNPs, and the like.

Minimum CRISPR Repeat Sequence

In some embodiments, a minimum CRISPR repeat sequence is a sequence with at least about 30%, about 40%, about 50%, about 60%, about 65%, about 70%, about 75%, about 80%, about 85%, about 90%, about 95%, or 100% sequence identity to a reference CRISPR repeat sequence (e.g., crRNA from S. pyogenes).

A minimum CRISPR repeat sequence comprises nucleotides that can hybridize to a minimum tracrRNA sequence in a cell. The minimum CRISPR repeat sequence and a minimum tracrRNA sequence form a duplex, i.e. a base-paired double-stranded structure. Together, the minimum CRISPR repeat sequence and the minimum tracrRNA sequence bind to the site-directed polypeptide. At least a part of the minimum CRISPR repeat sequence hybridizes to the minimum tracrRNA sequence. In some embodiments, at least a part of the minimum CRISPR repeat sequence comprises at least about 30%, about 40%, about 50%, about 60%, about 65%, about 70%, about 75%, about 80%, about 85%, about 90%, about 95%, or 100% complementary to the minimum tracrRNA sequence. In some embodiments, at least a part of the minimum CRISPR repeat sequence comprises at most about 30%, about 40%, about 50%, about 60%, about 65%, about 70%, about 75%, about 80%, about 85%, about 90%, about 95%, or 100% complementary to the minimum tracrRNA sequence.

The minimum CRISPR repeat sequence can have a length from about 7 nucleotides to about 100 nucleotides. For example, the length of the minimum CRISPR repeat sequence is from about 7 nucleotides (nt) to about 50 nt, from about 7 nt to about 40 nt, from about 7 nt to about 30 nt, from about 7 nt to about 25 nt, from about 7 nt to about 20 nt, from about 7 nt to about 15 nt, from about 8 nt to about 40 nt, from about 8 nt to about 30 nt, from about 8 nt to about 25 nt, from about 8 nt to about 20 nt, from about 8 nt to about 15 nt, from about 15 nt to about 100 nt, from about 15 nt to about 80 nt, from about 15 nt to about 50 nt, from about 15 nt to about 40 nt, from about 15 nt to about 30 nt, or from about 15 nt to about 25 nt. In some embodiments, the minimum CRISPR repeat sequence is approximately 9 nucleotides in length. In some embodiments, the minimum CRISPR repeat sequence is approximately 12 nucleotides in length.

In some embodiments, the minimum CRISPR repeat sequence is at least about 60% identical to a reference minimum CRISPR repeat sequence (e.g., wild-type crRNA from S. pyogenes) over a stretch of at least 6, 7, or 8 contiguous nucleotides. For example, the minimum CRISPR repeat sequence is at least about 65% identical, at least about 70% identical, at least about 75% identical, at least about 80% identical, at least about 85% identical, at least about 90% identical, at least about 95% identical, at least about 98% identical, at least about 99% identical or 100% identical to a reference minimum CRISPR repeat sequence over a stretch of at least 6, 7, or 8 contiguous nucleotides.

Minimum tracrRNA Sequence

In some embodiments, a minimum tracrRNA sequence is a sequence with at least about 30%, about 40%, about 50%, about 60%, about 65%, about 70%, about 75%, about 80%, about 85%, about 90%, about 95%, or 100% sequence identity to a reference tracrRNA sequence (e.g., wild type tracrRNA from S. pyogenes).

A minimum tracrRNA sequence comprises nucleotides that hybridize to a minimum CRISPR repeat sequence in a cell. A minimum tracrRNA sequence and a minimum CRISPR repeat sequence form a duplex, i.e. a base-paired double-stranded structure. Together, the minimum tracrRNA sequence and the minimum CRISPR repeat bind to a site-directed polypeptide. At least a part of the minimum tracrRNA sequence can hybridize to the minimum CRISPR repeat sequence. In some embodiments, the minimum tracrRNA sequence is at least about 30%, about 40%, about 50%, about 60%, about 65%, about 70%, about 75%, about 80%, about 85%, about 90%, about 95%, or 100% complementary to the minimum CRISPR repeat sequence.

The minimum tracrRNA sequence can have a length from about 7 nucleotides to about 100 nucleotides. For example, the minimum tracrRNA sequence can be from about 7 nucleotides (nt) to about 50 nt, from about 7 nt to about 40 nt, from about 7 nt to about 30 nt, from about 7 nt to about 25 nt, from about 7 nt to about 20 nt, from about 7 nt to about 15 nt, from about 8 nt to about 40 nt, from about 8 nt to about 30 nt, from about 8 nt to about 25 nt, from about 8 nt to about 20 nt, from about 8 nt to about 15 nt, from about 15 nt to about 100 nt, from about 15 nt to about 80 nt, from about 15 nt to about 50 nt, from about 15 nt to about 40 nt, from about 15 nt to about 30 nt or from about 15 nt to about 25 nt long. In some embodiments, the minimum tracrRNA sequence is approximately 9 nucleotides in length. In some embodiments, the minimum tracrRNA sequence is approximately 12 nucleotides. In some embodiments, the minimum tracrRNA consists of tracrRNA nt 23-48 described in Jinek et al., supra.

In some embodiments, the minimum tracrRNA sequence is at least about 60% identical to a reference minimum tracrRNA (e.g., wild type, tracrRNA from S. pyogenes) sequence over a stretch of at least 6, 7, or 8 contiguous nucleotides. For example, the minimum tracrRNA sequence is at least about 65% identical, about 70% identical, about 75% identical, about 80% identical, about 85% identical, about 90% identical, about 95% identical, about 98% identical, about 99% identical or 100% identical to a reference minimum tracrRNA sequence over a stretch of at least 6, 7, or 8 contiguous nucleotides.

In some embodiments, the duplex between the minimum CRISPR RNA and the minimum tracrRNA comprises a double helix. In some embodiments, the duplex between the minimum CRISPR RNA and the minimum tracrRNA comprises at least about 1, 2, 3, 4, 5, 6, 7, 8, 9, or 10 or more nucleotides. In some embodiments, the duplex between the minimum CRISPR RNA and the minimum tracrRNA comprises at most about 1, 2, 3, 4, 5, 6, 7, 8, 9, or 10 or more nucleotides.

In some embodiments, the duplex comprises a mismatch (i.e., the two strands of the duplex are not 100% complementary). In some embodiments, the duplex comprises at least about 1, 2, 3, 4, or 5 or mismatches. In some embodiments, the duplex comprises at most about 1, 2, 3, 4, or 5 or mismatches. In some embodiments, the duplex comprises no more than 2 mismatches.

Bulges

In some embodiments, there is a "bulge" in the duplex between the minimum CRISPR RNA and the minimum tracrRNA. A bulge is an unpaired region of nucleotides within the duplex. In some embodiments, the bulge contributes to the binding of the duplex to the site-directed polypeptide. In some embodiments, the bulge comprises, on one side of the duplex, an unpaired 5'-XXXY-3' where X is any purine and Y comprises a nucleotide that can form a wobble pair with a nucleotide on the opposite strand, and an unpaired nucleotide region on the other side of the duplex. The number of unpaired nucleotides on the two sides of the duplex can be different.

In some embodiments, the bulge comprises an unpaired purine (e.g., adenine) on the minimum CRISPR repeat strand of the bulge. In some embodiments, the bulge comprises an unpaired 5'-AAGY-3' of the minimum tracrRNA sequence strand of the bulge, where Y comprises a nucleotide that can form a wobble pairing with a nucleotide on the minimum CRISPR repeat strand.

In some embodiments, a bulge on the minimum CRISPR repeat side of the duplex comprises at least 1, 2, 3, 4, or 5 or more unpaired nucleotides. In some embodiments, a bulge on the minimum CRISPR repeat side of the duplex comprises at most 1, 2, 3, 4, or 5 or more unpaired nucleotides. In some embodiments, a bulge on the minimum CRISPR repeat side of the duplex comprises 1 unpaired nucleotide.

In some embodiments, a bulge on the minimum tracrRNA sequence side of the duplex comprises at least 1, 2, 3, 4, 5, 6, 7, 8, 9, or 10 or more unpaired nucleotides. In some embodiments, a bulge on the minimum tracrRNA sequence side of the duplex comprises at most 1, 2, 3, 4, 5, 6, 7, 8, 9, or 10 or more unpaired nucleotides. In some embodiments, a bulge on a second side of the duplex (e.g., the minimum tracrRNA sequence side of the duplex) comprises 4 unpaired nucleotides.

In some embodiments, a bulge comprises at least one wobble pairing. In some embodiments, a bulge comprises at most one wobble pairing. In some embodiments, a bulge comprises at least one purine nucleotide. In some embodiments, a bulge comprises at least 3 purine nucleotides. In some embodiments, a bulge sequence comprises at least 5 purine nucleotides. In some embodiments, a bulge sequence comprises at least one guanine nucleotide. In some embodiments, a bulge sequence comprises at least one adenine nucleotide.

Hairpins

In various embodiments, one or more hairpins are located 3' to the minimum tracrRNA in the 3' tracrRNA sequence.

In some embodiments, the hairpin starts at least about 1, 2, 3, 4, 5, 6, 7, 8, 9, 10, 15, or 20 or more nucleotides 3' from the last paired nucleotide in the minimum CRISPR repeat and minimum tracrRNA sequence duplex. In some embodiments, the hairpin starts at most about 1, 2, 3, 4, 5, 6, 7, 8, 9 or 10 or more nucleotides 3' of the last paired nucleotide in the minimum CRISPR repeat and minimum tracrRNA sequence duplex.

In some embodiments, the hairpin comprises at least about 1, 2, 3, 4, 5, 6, 7, 8, 9, 10, 15, or 20 or more consecutive nucleotides. In some embodiments, the hairpin comprises at most about 1, 2, 3, 4, 5, 6, 7, 8, 9, 10, 15, or more consecutive nucleotides.

In some embodiments, the hairpin comprises a CC dinucleotide (i.e., two consecutive cytosine nucleotides).

In some embodiments, the hairpin comprises duplexed nucleotides (e.g., nucleotides in a hairpin, hybridized together). For example, a hairpin comprises a CC dinucleotide that is hybridized to a GG dinucleotide in a hairpin duplex of the 3' tracrRNA sequence.

One or more of the hairpins can interact with guide RNA-interacting regions of a site-directed polypeptide.

In some embodiments, there are two or more hairpins, and in other embodiments there are three or more hairpins.

3' tracrRNA Sequence

In some embodiments, a 3' tracrRNA sequence comprises a sequence with at least about 30%, about 40%, about 50%, about 60%, about 65%, about 70%, about 75%, about 80%, about 85%, about 90%, about 95%, or 100% sequence identity to a reference tracrRNA sequence (e.g., a tracrRNA from S. pyogenes).

The 3' tracrRNA sequence has a length from about 6 nucleotides to about 100 nucleotides. For example, the 3' tracrRNA sequence can have a length from about 6 nucleotides (nt) to about 50 nt, from about 6 nt to about 40 nt, from about 6 nt to about 30 nt, from about 6 nt to about 25 nt, from about 6 nt to about 20 nt, from about 6 nt to about 15 nt, from about 8 nt to about 40 nt, from about 8 nt to about 30 nt, from about 8 nt to about 25 nt, from about 8 nt to about 20 nt, from about 8 nt to about 15 nt, from about 15 nt to about 100 nt, from about 15 nt to about 80 nt, from about 15 nt to about 50 nt, from about 15 nt to about 40 nt, from about 15 nt to about 30 nt, or from about 15 nt to about 25 nt. In some embodiments, the 3' tracrRNA sequence has a length of approximately 14 nucleotides.

In some embodiments, the 3' tracrRNA sequence is at least about 60% identical to a reference 3' tracrRNA sequence (e.g., wild type 3' tracrRNA sequence from S. pyogenes) over a stretch of at least 6, 7, or 8 contiguous nucleotides. For example, the 3' tracrRNA sequence is at least about 60% identical, about 65% identical, about 70% identical, about 75% identical, about 80% identical, about 85% identical, about 90% identical, about 95% identical, about 98% identical, about 99% identical, or 100% identical, to a reference 3' tracrRNA sequence (e.g., wild type 3' tracrRNA sequence from S. pyogenes) over a stretch of at least 6, 7, or 8 contiguous nucleotides.

In some embodiments, the 3' tracrRNA sequence comprises more than one duplexed region (e.g., hairpin, hybridized region). In some embodiments, the 3' tracrRNA sequence comprises two duplexed regions.

In some embodiments, the 3' tracrRNA sequence comprises a stem loop structure. In some embodiments, the stem loop structure in the 3' tracrRNA comprises at least 1, 2, 3, 4, 5, 6, 7, 8, 9, 10, 15 or 20 or more nucleotides. In some embodiments, the stem loop structure in the 3' tracrRNA comprises at most 1, 2, 3, 4, 5, 6, 7, 8, 9 or 10 or more nucleotides. In some embodiments, the stem loop structure comprises a functional moiety. For example, the stem loop structure may comprise an aptamer, a ribozyme, a protein-interacting hairpin, a CRISPR array, an intron, or an exon. In some embodiments, the stem loop structure comprises at least about 1, 2, 3, 4, or 5 or more functional moieties. In some embodiments, the stem loop structure comprises at most about 1, 2, 3, 4, or 5 or more functional moieties.

In some embodiments, the hairpin in the 3' tracrRNA sequence comprises a P-domain. In some embodiments, the P-domain comprises a double-stranded region in the hairpin.

tracrRNA Extension Sequence

In some embodiments, a tracrRNA extension sequence is provided whether the tracrRNA is in the context of single-molecule guides or double-molecule guides. In some embodiments, the tracrRNA extension sequence has a length from about 1 nucleotide to about 400 nucleotides. In some embodiments, the tracrRNA extension sequence has a length of more than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, or 400 nucleotides. In some embodiments, the tracrRNA extension sequence has a length from about 20 to about 5000 or more nucleotides. In some embodiments, the tracrRNA extension sequence has a length of more than 1000 nucleotides. In some embodiments, the tracrRNA extension sequence has a length of less than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400 or more nucleotides. In some embodiments, the tracrRNA extension sequence has a length of less than 1000 nucleotides. In some embodiments, the tracrRNA extension sequence comprises less than 10 nucleotides in length. In some embodiments, the tracrRNA extension sequence is 10-30 nucleotides in length. In some embodiments, the tracrRNA extension sequence is 30-70 nucleotides in length.

In some embodiments, the tracrRNA extension sequence comprises a functional moiety (e.g., a stability control sequence, ribozyme, endoribonuclease binding sequence). In some embodiments, the functional moiety comprises a transcriptional terminator segment (i.e., a transcription termination sequence). In some embodiments, the functional moiety has a total length from about 10 nucleotides (nt) to about 100 nucleotides, from about 10 nt to about 20 nt, from about 20 nt to about 30 nt, from about 30 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt, from about 15 nt to about 80 nt, from about 15 nt to about 50 nt, from about 15 nt to about 40 nt, from about 15 nt to about 30 nt, or from about 15 nt to about 25 nt. In some embodiments, the functional moiety functions in a eukaryotic cell. In some embodiments, the functional moiety functions in a prokaryotic cell. In some embodiments, the functional moiety functions in both eukaryotic and prokaryotic cells.

Non-limiting examples of suitable tracrRNA extension functional moieties include a 3' poly-adenylated tail, a riboswitch sequence (e.g., to allow for regulated stability and/or regulated accessibility by proteins and protein complexes), a sequence that forms a dsRNA duplex (i.e., a hairpin), a sequence that targets the RNA to a subcellular location (e.g., nucleus, mitochondria, chloroplasts, and the like), a modification or sequence that provides for tracking (e.g., direct conjugation to a fluorescent molecule, conjugation to a moiety that facilitates fluorescent detection, a sequence that allows for fluorescent detection, etc.), and/or a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like). In some embodiments, the tracrRNA extension sequence comprises a primer binding site or a molecular index (e.g., barcode sequence). In some embodiments, the tracrRNA extension sequence comprises one or more affinity tags.

Single-Molecule Guide Linker Sequence

In some embodiments, the linker sequence of a single-molecule guide nucleic acid has a length from about 3 nucleotides to about 100 nucleotides. In Jinek et al., supra, for example, a simple 4 nucleotide "tetraloop" (-GAAA-) was used, Science, 337(6096):816-821 (2012). An illustrative linker has a length from about 3 nucleotides (nt) to about 90 nt, from about 3 nt to about 80 nt, from about 3 nt to about 70 nt, from about 3 nt to about 60 nt, from about 3 nt to about 50 nt, from about 3 nt to about 40 nt, from about 3 nt to about 30 nt, from about 3 nt to about 20 nt, from about 3 nt to about 10 nt. For example, the linker can have a length from about 3 nt to about 5 nt, from about 5 nt to about 10 nt, from about 10 nt to about 15 nt, from about 15 nt to about 20 nt, from about 20 nt to about 25 nt, from about 25 nt to about 30 nt, from about 30 nt to about 35 nt, from about 35 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt. In some embodiments, the linker of a single-molecule guide nucleic acid is between 4 and 40 nucleotides. In some embodiments, the linker is at least about 100, 500, 1000, 1500, 2000, 2500, 3000, 3500, 4000, 4500, 5000, 5500, 6000, 6500, or 7000 or more nucleotides. In some embodiments, the linker is at most about 100, 500, 1000, 1500, 2000, 2500, 3000, 3500, 4000, 4500, 5000, 5500, 6000, 6500, or 7000 or more nucleotides.

Linkers comprise any of a variety of sequences, although in some examples the linker will not comprise sequences that have extensive regions of homology with other portions of the guide RNA, which might cause intramolecular binding that could interfere with other functional regions of the guide. In Jinek et al., supra, a simple 4 nucleotide sequence -GAAA- was used, Science, 337(6096):816-821 (2012), but numerous other sequences, including longer sequences can likewise be used.

In some embodiments, the linker sequence comprises a functional moiety. For example, the linker sequence may comprise one or more features, including an aptamer, a ribozyme, a protein-interacting hairpin, a protein binding site, a CRISPR array, an intron, or an exon. In some embodiments, the linker sequence comprises at least about 1, 2, 3, 4, or 5 or more functional moieties. In some embodiments, the linker sequence comprises at most about 1, 2, 3, 4, or 5 or more functional moieties.

Genome Engineering Strategies to Edit Cells by Deletion, Insertion, or Modulation of One or More Nucleic Acids or Exons Within or Near a Target Gene, and by Knocking-In cDNA, an Expression Vector, or Minigene into the Locus of the Corresponding Target Gene Some genome engineering strategies involve deleting the target DNA and/or knocking-in cDNA, expression vector, or a minigene (comprised of one or more exons and introns or natural or synthetic introns) and/or knocking-in a cDNA interrupted by some or all target introns into the locus of the corresponding gene. These strategies treat, and/or mitigate the diseased state. These strategies may require a more custom approach. This is advantageous, as HDR efficiencies may be inversely related to the size of the donor molecule. Also, it is expected that the donor templates can fit into size constrained viral vector molecules, e.g., adeno-associated virus (AAV) molecules, which have been shown to be an effective means of donor template delivery. Also, it is expected that the donor templates can fit into other size constrained molecules, including, by way of non-limiting example, platelets and/or exosomes or other microvesicles.

Homology direct repair is a cellular mechanism for repairing double-stranded breaks (DSBs). The most common form is homologous recombination. There are additional pathways for HDR, including single-strand annealing and alternative-HDR. Genome engineering tools allow researchers to manipulate the cellular homologous recombination pathways to create site-specific modifications to the genome. It has been found that cells can repair a double-stranded break using a synthetic donor molecule provided in trans. Therefore, by introducing a double-stranded break near a specific mutation and providing a suitable donor, targeted changes can be made in the genome. Specific cleavage increases the rate of HDR more than 1,000 fold above the rate of 1 in $10^6$ cells receiving a homologous donor alone. The rate of homology directed repair (HDR) at a particular nucleotide is a function of the distance to the cut site, so choosing overlapping or nearest target sites is important. Gene editing offers the advantage over gene addition, as correcting in situ leaves the rest of the genome unperturbed.

Supplied donors for editing by HDR vary markedly but generally contain the intended sequence with small or large flanking homology arms to allow annealing to the genomic DNA. The homology regions flanking the introduced genetic changes can be 30 bp or smaller or as large as a multi-kilobase cassette that can contain promoters, cDNAs, etc. Both single-stranded and double-stranded oligonucleotide donors have been used. These oligonucleotides range in size from less than 100 nt to over many kb, though longer ssDNA can also be generated and used. Double-stranded donors are often used, including PCR amplicons, plasmids, and mini-circles. In general, it has been found that an AAV vector is a very effective means of delivery of a donor template, though the packaging limits for individual donors is <5 kb. Active transcription of the donor increased HDR three-fold, indicating the inclusion of promoter may increase conversion. Conversely, CpG methylation of the donor decreased gene expression and HDR.

In addition to wildtype endonucleases, such as Cas9, nickase variants exist that have one or the other nuclease domain inactivated resulting in cutting of only one DNA strand. HDR can be directed from individual Cas nickases or using pairs of nickases that flank the target area. Donors can be single-stranded, nicked, or dsDNA.

The donor DNA can be supplied with the nuclease or independently by a variety of different methods, for example by transfection, nano-particle, micro-injection, or viral transduction. A range of tethering options has been proposed to increase the availability of the donors for HDR. Examples include attaching the donor to the nuclease, attaching to DNA binding proteins that bind nearby, or attaching to proteins that are involved in DNA end binding or repair.

The repair pathway choice can be guided by a number of culture conditions, such as those that influence cell cycling, or by targeting of DNA repair and associated proteins. For example, to increase HDR, key NHEJ molecules can be suppressed, such as KU70, KU80 or DNA ligase IV.

Without a donor present, the ends from a DNA break or ends from different breaks can be joined using the several nonhomologous repair pathways in which the DNA ends are joined with little or no base-pairing at the junction. In addition to canonical NHEJ, there are similar repair mechanisms, such as alt-NHEJ. If there are two breaks, the intervening segment can be deleted or inverted. NHEJ repair pathways can lead to insertions, deletions or mutations at the joints.

NHEJ was used to insert a gene expression cassette into a defined locus in human cell lines after nuclease cleavage of both the chromosome and the donor molecule. (Cristea, et al., *Biotechnology and Bioengineering* 110:871-880 (2012); Maresca, M., Lin, V. G., Guo, N. & Yang, Y., *Genome Res* 23, 539-546 (2013)).

In addition to genome editing by NHEJ or HDR, site-specific gene insertions have been conducted that use both the NHEJ pathway and HR. A combination approach may be applicable in certain settings, possibly including intron/exon borders. NHEJ may prove effective for ligation in the intron, while the error-free HDR may be better suited in the coding region.

The target gene contains a number of exons. Any one or more of the exons or nearby introns may be targeted. Alternatively, there are various mutations associated with various medical conditions, which are a combination of insertions, deletions, missense, nonsense, frameshift and other mutations, with the common effect of inactivating target. Any one or more of the mutations may be repaired in order to restore the inactive target. As a further alternative, a cDNA construct, expression vector, or minigene (comprised of, natural or synthetic enhancer and promoter, one or more exons, and natural or synthetic introns, and natural or synthetic 3'UTR and polyadenylation signal) may be knocked-in to the genome or a target gene. In some embodiments, the methods can provide one gRNA or a pair of gRNAs that can be used to facilitate incorporation of a new sequence from a polynucleotide donor template to knock-in a cDNA construct, expression vector, or minigene Some embodiments of the methods provide gRNA pairs that make a deletion by cutting the gene twice, one gRNA cutting at the 5' end of one or more mutations and the other gRNA cutting at the 3' end of one or more mutations that facilitates insertion of a new sequence from a polynucleotide donor template to replace the one or more mutations, or deletion may exclude mutant amino acids or amino acids adjacent to it (e.g., premature stop codon) and lead to expression of a functional protein, or restore an open reading frame. The cutting may be accomplished by a pair of DNA endonucleases that each makes a DSB in the genome, or by multiple nickases that together make a DSB in the genome.

Alternatively, some embodiments of the methods provide one gRNA to make one double-strand cut around one or more mutations that facilitates insertion of a new sequence from a polynucleotide donor template to replace the one or more mutations. The double-strand cut may be made by a single DNA endonuclease or multiple nickases that together make a DSB in the genome, or single gRNA may lead to deletion (MMEJ), which may exclude mutant amino acid (e.g., premature stop codon) and lead to expression of a functional protein, or restore an open reading frame.

Illustrative modifications within the target gene include replacements within or near (proximal) to the mutations referred to above, such as within the region of less than 3 kb, less than 2 kb, less than 1 kb, less than 0.5 kb upstream or downstream of the specific mutation. Given the relatively wide variations of mutations in the target gene, it will be appreciated that numerous variations of the replacements referenced above (including without limitation larger as well as smaller deletions), would be expected to result in restoration of the target gene.

Such variants include replacements that are larger in the 5' and/or 3' direction than the specific mutation in question, or smaller in either direction. Accordingly, by "near" or "proximal" with respect to specific replacements, it is intended that the SSB or DSB locus associated with a desired replacement boundary (also referred to herein as an endpoint) may be within a region that is less than about 3 kb from the reference locus noted. In some embodiments, the SSB or DSB locus is more proximal and within 2 kb, within 1 kb, within 0.5 kb, or within 0.1 kb. In the case of small replacement, the desired endpoint is at or "adjacent to" the reference locus, by which it is intended that the endpoint is within 100 bp, within 50 bp, within 25 bp, or less than about 10 bp to 5 bp from the reference locus. Embodiments comprising larger or smaller replacements is expected to provide the same benefit, as long as the target protein activity is restored. It is thus expected that many variations of the replacements described and illustrated herein will be effective for ameliorating a medical condition.

Another genome engineering strategy involves exon deletion. Targeted deletion of specific exons is an attractive strategy for treating a large subset of patients with a single therapeutic cocktail. Deletions can either be single exon deletions or multi-exon deletions. While multi-exon deletions can reach a larger number of patients, for larger deletions the efficiency of deletion greatly decreases with increased size. Therefore, deletions range can be from 40 to 10,000 base pairs (bp) in size. For example, deletions may range from 40-100; 100-300; 300-500; 500-1,000; 1,000-2,000; 2,000-3,000; 3,000-5,000; or 5,000-10,000 base pairs in size.

Deletions can occur in enhancer, promoter, 1st intron, and/or 3'UTR leading to upregulation of the gene expression, and/or through deletion of the regulatory elements.

In order to ensure that the pre-mRNA is properly processed following deletion, the surrounding splicing signals can be deleted. Splicing donor and acceptors are generally within 100 base pairs of the neighboring intron. Therefore, in some embodiments, methods can provide all gRNAs that cut approximately +/−100-3100 bp with respect to each exon/intron junction of interest.

For any of the genome editing strategies, gene editing can be confirmed by sequencing or PCR analysis.

Target Sequence Selection

Shifts in the location of the 5' boundary and/or the 3' boundary relative to particular reference loci are used to facilitate or enhance particular applications of gene editing, which depend in part on the endonuclease system selected for the editing, as further described and illustrated herein.

In a first, nonlimiting example of such target sequence selection, many endonuclease systems have rules or criteria that guide the initial selection of potential target sites for cleavage, such as the requirement of a PAM sequence motif in a particular position adjacent to the DNA cleavage sites in the case of CRISPR Type II or Type V endonucleases.

In another nonlimiting example of target sequence selection or optimization, the frequency of off-target activity for a particular combination of target sequence and gene editing endonuclease (i.e. the frequency of DSBs occurring at sites other than the selected target sequence) is assessed relative to the frequency of on-target activity. In some embodiments, cells that have been correctly edited at the desired locus may have a selective advantage relative to other cells. Illustrative, but nonlimiting, examples of a selective advantage include the acquisition of attributes such as enhanced rates of replication, persistence, resistance to certain conditions, enhanced rates of successful engraftment or persistence in vivo following introduction into a patient, and other attributes associated with the maintenance or increased numbers or viability of such cells. In other embodiments, cells that have been correctly edited at the desired locus may be positively selected for by one or more screening methods used to identify, sort or otherwise select for cells that have been correctly edited. Both selective advantage and directed selection methods may take advantage of the phenotype associated with the correction. In some embodiments, cells may be edited two or more times in order to create a second modification that creates a new phenotype that is used to select or purify the intended population of cells. Such a second modification could be created by adding a second gRNA for a selectable or screenable marker. In some embodiments, cells can be correctly edited at the desired locus using a DNA fragment that contains the cDNA and also a selectable marker.

Whether any selective advantage is applicable or any directed selection is to be applied in a particular case, target sequence selection is also guided by consideration of off-target frequencies in order to enhance the effectiveness of the application and/or reduce the potential for undesired alterations at sites other than the desired target. As described further and illustrated herein and in the art, the occurrence of off-target activity is influenced by a number of factors including similarities and dissimilarities between the target site and various off-target sites, as well as the particular endonuclease used. Bioinformatics tools are available that assist in the prediction of off-target activity, and frequently such tools can also be used to identify the most likely sites of off-target activity, which can then be assessed in experimental settings to evaluate relative frequencies of off-target to on-target activity, thereby allowing the selection of sequences that have higher relative on-target activities. Illustrative examples of such techniques are provided herein, and others are known in the art.

Another aspect of target sequence selection relates to homologous recombination events. Sequences sharing regions of homology can serve as focal points for homologous recombination events that result in deletion of intervening sequences. Such recombination events occur during the normal course of replication of chromosomes and other DNA sequences, and also at other times when DNA sequences are being synthesized, such as in the case of repairs of double-strand breaks (DSBs), which occur on a regular basis during the normal cell replication cycle but may also be enhanced by the occurrence of various events (such as UV light and other inducers of DNA breakage) or the presence of certain agents (such as various chemical inducers). Many such inducers cause DSBs to occur indiscriminately in the genome, and DSBs are regularly being induced and repaired in normal cells. During repair, the original sequence may be reconstructed with complete fidelity, however, in some embodiments, small insertions or deletions (referred to as "indels") are introduced at the DSB site.

DSBs may also be specifically induced at particular locations, as in the case of the endonucleases systems described herein, which can be used to cause directed or preferential gene modification events at selected chromosomal locations. The tendency for homologous sequences to be subject to recombination in the context of DNA repair (as well as replication) can be taken advantage of in a number of circumstances, and is the basis for one application of gene editing systems, such as CRISPR, in which homology directed repair is used to insert a sequence of interest, provided through use of a "donor" polynucleotide, into a desired chromosomal location.

Regions of homology between particular sequences, which can be small regions of "microhomology" that may comprise as few as ten basepairs or less, can also be used to bring about desired deletions. For example, a single DSB is introduced at a site that exhibits microhomology with a nearby sequence. During the normal course of repair of such DSB, a result that occurs with high frequency is the deletion of the intervening sequence as a result of recombination being facilitated by the DSB and concomitant cellular repair process.

In some circumstances, however, selecting target sequences within regions of homology can also give rise to much larger deletions, including gene fusions (when the deletions are in coding regions), which may or may not be desired given the particular circumstances.

The examples provided herein further illustrate the selection of various target regions for the creation of DSBs designed to induce replacements that result in modulation of target protein activity, as well as the selection of specific target sequences within such regions that are designed to minimize off-target events relative to on-target events.

Nucleic Acid Modifications

In some embodiments, polynucleotides introduced into cells comprise one or more modifications that can be used individually or in combination, for example, to enhance activity, stability or specificity, alter delivery, reduce innate immune responses in host cells, or for other enhancements, as further described herein and known in the art.

In some embodiments, modified polynucleotides are used in the CRISPR/Cas9/Cpf1 system, in which case the guide RNAs (either single-molecule guides or double-molecule guides) and/or a DNA or an RNA encoding a Cas or Cpf1 endonuclease introduced into a cell can be modified, as described and illustrated below. Such modified polynucleotides can be used in the CRISPR/Cas9/Cpf1 system to edit any one or more genomic loci.

Using the CRISPR/Cas9/Cpf1 system for purposes of nonlimiting illustrations of such uses, modifications of guide RNAs can be used to enhance the formation or stability of the CRISPR/Cas9/Cpf1 genome editing complex comprising guide RNAs, which may be single-molecule guides or double-molecule, and a Cas or Cpf1 endonuclease. Modifications of guide RNAs can also or alternatively be used to enhance the initiation, stability or kinetics of interactions between the genome editing complex with the target sequence in the genome, which can be used, for example, to enhance on-target activity. Modifications of guide RNAs can also or alternatively be used to enhance specificity, e.g., the relative rates of genome editing at the on-target site as compared to effects at other (off-target) sites.

Modifications can also or alternatively be used to increase the stability of a guide RNA, e.g., by increasing its resistance to degradation by ribonucleases (RNases) present in a cell, thereby causing its half-life in the cell to be increased. Modifications enhancing guide RNA half-life can be particularly useful in aspects in which a Cas or Cpf1 endonuclease is introduced into the cell to be edited via an RNA that needs to be translated in order to generate endonuclease, because increasing the half-life of guide RNAs introduced at the same time as the RNA encoding the endonuclease can be used to increase the time that the guide RNAs and the encoded Cas or Cpf1 endonuclease co-exist in the cell.

Modifications can also or alternatively be used to decrease the likelihood or degree to which RNAs introduced into cells elicit innate immune responses. Such responses, which have been well characterized in the context of RNA interference (RNAi), including small-interfering RNAs (siRNAs), as described below and in the art, tend to be associated with reduced half-life of the RNA and/or the elicitation of cytokines or other factors associated with immune responses.

One or more types of modifications can also be made to RNAs encoding an endonuclease that are introduced into a cell, including, without limitation, modifications that enhance the stability of the RNA (such as by increasing its degradation by RNAses present in the cell), modifications that enhance translation of the resulting product (i.e. the endonuclease), and/or modifications that decrease the likelihood or degree to which the RNAs introduced into cells elicit innate immune responses.

Combinations of modifications, such as the foregoing and others, can likewise be used. In the case of CRISPR/Cas9/Cpf1, for example, one or more types of modifications can be made to guide RNAs (including those exemplified above), and/or one or more types of modifications can be made to RNAs encoding Cas endonuclease (including those exemplified above).

By way of illustration, guide RNAs used in the CRISPR/Cas9/Cpf1 system, or other smaller RNAs can be readily synthesized by chemical means, enabling a number of modifications to be readily incorporated, as illustrated below and described in the art. While chemical synthetic procedures are continually expanding, purifications of such RNAs by procedures such as high performance liquid chromatography (HPLC, which avoids the use of gels such as PAGE) tends to become more challenging as polynucleotide lengths increase significantly beyond a hundred or so nucleotides. One approach used for generating chemically-modified RNAs of greater length is to produce two or more molecules that are ligated together. Much longer RNAs, such as those encoding a Cas9 endonuclease, are more readily generated enzymatically. While fewer types of modifications are generally available for use in enzymatically produced RNAs, there are still modifications that can be used to, e.g., enhance stability, reduce the likelihood or degree of innate immune response, and/or enhance other attributes, as described further below and in the art; and new types of modifications are regularly being developed.

By way of illustration of various types of modifications, especially those used frequently with smaller chemically synthesized RNAs, modifications can comprise one or more nucleotides modified at the 2' position of the sugar, in some embodiments, a 2'-O-alkyl, 2'-O-alkyl-O-alkyl, or 2'-fluoro-modified nucleotide. In some embodiments, RNA modifications comprise 2'-fluoro, 2'-amino or 2' O-methyl modifications on the ribose of pyrimidines, abasic residues, or an inverted base at the 3' end of the RNA. Such modifications are routinely incorporated into oligonucleotides and these oligonucleotides have been shown to have a higher Tm (i.e., higher target binding affinity) than 2'-deoxyoligonucleotides against a given target.

A number of nucleotide and nucleoside modifications have been shown to make the oligonucleotide into which they are incorporated more resistant to nuclease digestion than the native oligonucleotide; these modified oligos survive intact for a longer time than unmodified oligonucleotides. Specific examples of modified oligonucleotides include those comprising modified backbones, for example, phosphorothioates, phosphotriesters, methyl phosphonates, short chain alkyl or cycloalkyl intersugar linkages or short chain heteroatomic or heterocyclic intersugar linkages. Some oligonucleotides are oligonucleotides with phosphorothioate backbones and those with heteroatom backbones, particularly $CH_2$—NH—O—$CH_2$, CH, ~N($CH_3$)~O~$CH_2$ (known as a methylene(methylimino) or MMI backbone), $CH_2$—O—N ($CH_3$)—$CH_2$, $CH_2$—N($CH_3$)—N($CH_3$)—$CH_2$ and O—N ($CH_3$)—$CH_2$—$CH_2$ backbones, wherein the native phosphodiester backbone is represented as O—P—O—CH,); amide backbones [see De Mesmaeker et al., Ace. Chem. Res., 28:366-374 (1995)]; morpholino backbone structures (see Summerton and Weller, U.S. Pat. No. 5,034,506); peptide nucleic acid (PNA) backbone (wherein the phosphodiester backbone of the oligonucleotide is replaced with a polyamide backbone, the nucleotides being bound directly or indirectly to the aza nitrogen atoms of the polyamide backbone, see Nielsen et al., Science 1991, 254, 1497). Phosphorus-containing linkages include, but are not limited to, phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'; see U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; and 5,625,050, each of which is herein incorporated by reference.

Morpholino-based oligomeric compounds are described in Braasch and David Corey, Biochemistry, 41(14): 4503-4510 (2002); Genesis, Volume 30, Issue 3, (2001); Heasman, Dev. Biol., 243: 209-214 (2002); Nasevicius et al., Nat. Genet., 26:216-220 (2000); Lacerra et al., Proc. Natl. Acad. Sci., 97: 9591-9596 (2000); and U.S. Pat. No. 5,034,506, issued Jul. 23, 1991.

Cyclohexenyl nucleic acid oligonucleotide mimetics are described in Wang et al., J. Am. Chem. Soc., 122: 8595-8602 (2000).

Modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These comprise those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S, and $CH_2$ component parts; see U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439, each of which is herein incorporated by reference.

One or more substituted sugar moieties can also be included, e.g., one of the following at the 2' position: OH, SH, $SCH_3$, F, OCN, $OCH_3$, $OCH_3$ $O(CH_2)$n $CH_3$, $O(CH_2)$n $NH_2$, or $O(CH_2)$n $CH_3$, where n is from 1 to about 10; C1 to C10 lower alkyl, alkoxyalkoxy, substituted lower alkyl, alkaryl or aralkyl; Cl; Br; CN; $CF_3$; $OCF_3$; O—, S—, or N-alkyl; O—, S—, or N-alkenyl; $SOCH_3$; $SO_2$ $CH_3$; $ONO_2$; $NO_2$; $N_3$; $NH_2$; heterocycloalkyl; heterocycloalkaryl; aminoalkylamino; polyalkylamino; substituted silyl; an RNA cleaving group; a reporter group; an intercalator; a group for improving the pharmacokinetic properties of an oligonucleotide; or a group for improving the pharmacodynamic properties of an oligonucleotide and other substituents having similar properties. In some embodiments, a modification includes 2'-methoxyethoxy (2'-0-$CH_2CH_2OCH_3$, also known as 2'-O-(2-methoxyethyl)) (Martin et al, Helv. Chim. Acta, 1995, 78, 486). Other modifications include 2'-methoxy (2'-0-$CH_3$), 2'-propoxy (2'-OCH$_2$ CH$_2$CH$_3$) and 2'-fluoro (2'-F). Similar modifications may also be made at other positions on the oligonucleotide, particularly the 3' position of the sugar on the 3' terminal nucleotide and the 5' position of 5' terminal nucleotide. Oligonucleotides may also have sugar mimetics, such as cyclobutyls in place of the pentofuranosyl group.

In some embodiments, both a sugar and an internucleoside linkage, i.e., the backbone, of the nucleotide units are replaced with novel groups. The base units are maintained for hybridization with an appropriate nucleic acid target compound. One such oligomeric compound, an oligonucleotide mimetic that has been shown to have excellent hybridization properties, is referred to as a peptide nucleic acid (PNA). In PNA compounds, the sugar-backbone of an oligonucleotide is replaced with an amide containing backbone, for example, an aminoethylglycine backbone. The nucleobases are retained and are bound directly or indirectly to aza nitrogen atoms of the amide portion of the backbone. Representative United States patents that teach the preparation of PNA compounds comprise, but are not limited to, U.S. Pat. Nos. 5,539,082; 5,714,331; and 5,719,262. Further teaching of PNA compounds can be found in Nielsen et al, Science, 254: 1497-1500 (1991).

Guide RNAs can also include, additionally or alternatively, nucleobase (often referred to in the art simply as "base") modifications or substitutions. As used herein, "unmodified" or "natural" nucleobases include adenine (A), guanine (G), thymine (T), cytosine (C), and uracil (U). Modified nucleobases include nucleobases found only infrequently or transiently in natural nucleic acids, e.g., hypoxanthine, 6-methyladenine, 5-Me pyrimidines, particularly 5-methylcytosine (also referred to as 5-methyl-2' deoxycytosine and often referred to in the art as 5-Me-C), 5-hydroxymethylcytosine (HMC), glycosyl HMC and gentobiosyl HMC, as well as synthetic nucleobases, e.g., 2-aminoadenine, 2-(methylamino)adenine, 2-(imidazolylalkyl)adenine, 2-(aminoalklyamino)adenine or other heterosubstituted alkyladenines, 2-thiouracil, 2-thiothymine, 5-bromouracil, 5-hydroxymethyluracil, 8-azaguanine, 7-deazaguanine, N6 (6-aminohexyl)adenine, and 2,6-diaminopurine. Kornberg, A., DNA Replication, W. H. Freeman & Co., San Francisco, pp 75-77 (1980); Gebeyehu et al., Nucl. Acids Res. 15:4513 (1997). A "universal" base known in the art, e.g., inosine, can also be included. 5-Me-C substitutions have been shown to increase nucleic acid duplex stability by 0.6-1.2° C. (Sanghvi, Y. S., in Crooke, S. T. and Lebleu, B., eds., Antisense Research and Applications, CRC Press, Boca Raton, 1993, pp. 276-278) and are embodiments of base substitutions.

Modified nucleobases comprise other synthetic and natural nucleobases, such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudo-uracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylquanine and 7-methyladenine, 8-azaguanine and 8-azaadenine, 7-deazaguanine and 7-deazaadenine, and 3-deazaguanine and 3-deazaadenine.

Further, nucleobases comprise those disclosed in U.S. Pat. No. 3,687,808, those disclosed in 'The Concise Encyclopedia of Polymer Science And Engineering', pages 858-859, Kroschwitz, J. I., ed. John Wiley & Sons, 1990, those disclosed by Englisch et al., Angewandle Chemie, International Edition', 1991, 30, page 613, and those disclosed by Sanghvi, Y. S., Chapter 15, Antisense Research and Applications', pages 289-302, Crooke, S. T. and Lebleu, B. ea., CRC Press, 1993. Certain of these nucleobases are particularly useful for increasing the binding affinity of the oligomeric compounds of the disclosure. These include 5-substituted pyrimidines, 6-azapyrimidines and N-2, N-6 and 0-6 substituted purines, comprising 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., eds, 'Antisense Research and Applications', CRC Press, Boca Raton, 1993, pp. 276-278) and are aspects of base substitutions, even more particularly when combined with 2'-O-methoxyethyl sugar modifications. Modified nucleobases are described in U.S. Pat. No. 3,687,808, as well as U.S. Pat. Nos. 4,845,205; 5,130,302; 5,134,066; 5,175,273; 5,367,066; 5,432,272; 5,457,187; 5,459,255; 5,484,908; 5,502,177; 5,525,711; 5,552,540; 5,587,469; 5,596,091; 5,614,617; 5,681,941; 5,750,692; 5,763,588; 5,830,653; 6,005,096; and US Patent Application Publication 2003/0158403.

Thus, the term "modified" refers to a non-natural sugar, phosphate, or base that is incorporated into a guide RNA, an endonuclease, or both a guide RNA and an endonuclease. It is not necessary for all positions in a given oligonucleotide to be uniformly modified, and in fact more than one of the aforementioned modifications may be incorporated in a single oligonucleotide, or even in a single nucleoside within an oligonucleotide.

In some embodiments, the guide RNAs and/or mRNA (or DNA) encoding an endonuclease are chemically linked to one or more moieties or conjugates that enhance the activity, cellular distribution, or cellular uptake of the oligonucleotide. Such moieties comprise, but are not limited to, lipid moieties such as a cholesterol moiety [Letsinger et al., Proc. Natl. Acad. Sci. USA, 86: 6553-6556 (1989)]; cholic acid [Manoharan et al., Bioorg. Med. Chem. Let., 4: 1053-1060 (1994)]; a thioether, e.g., hexyl-S-tritylthiol [Manoharan et al, Ann. N. Y. Acad. Sci., 660: 306-309 (1992) and Manoharan et al., Bioorg. Med. Chem. Let., 3: 2765-2770 (1993)]; a thiocholesterol [Oberhauser et al., Nucl. Acids Res., 20: 533-538 (1992)]; an aliphatic chain, e.g., dodecandiol or undecyl residues [Kabanov et al., FEBS Lett., 259: 327-330 (1990) and Svinarchuk et al., Biochimie, 75: 49-54 (1993)]; a phospholipid, e.g., di-hexadecyl-rac-glycerol or triethylammonium 1,2-di-O-hexadecyl-rac-glycero-3-H-phosphonate [Manoharan et al., Tetrahedron Lett., 36: 3651-3654 (1995) and Shea et al., Nucl. Acids Res., 18: 3777-3783 (1990)]; a polyamine or a polyethylene glycol chain [Mancharan et al., Nucleosides & Nucleotides, 14: 969-973 (1995)]; adamantane acetic acid [Manoharan et al., Tetrahedron Lett., 36: 3651-3654 (1995)]; a palmityl moiety [(Mishra et al., Biochim. Biophys. Acta, 1264: 229-237 (1995)]; or an octadecylamine or hexylamino-carbonyl-t oxycholesterol moiety [Crooke et al., J. Pharmacol. Exp. Ther., 277: 923-937 (1996)]. See also U.S. Pat. Nos. 4,828, 979; 4,948,882; 5,218,105; 5,525,465; 5,541,313; 5,545, 730; 5,552,538; 5,578,717; 5,580,731; 5,580,731; 5,591, 584; 5,109,124; 5,118,802; 5,138,045; 5,414,077; 5,486, 603; 5,512,439; 5,578,718; 5,608,046; 4,587,044; 4,605, 735; 4,667,025; 4,762,779; 4,789,737; 4,824,941; 4,835, 263; 4,876,335; 4,904,582; 4,958,013; 5,082,830; 5,112, 963; 5,214,136; 5,082,830; 5,112,963; 5,214,136; 5,245, 022; 5,254,469; 5,258,506; 5,262,536; 5,272,250; 5,292, 873; 5,317,098; 5,371,241; 5,391,723; 5,416,203; 5,451,463; 5,510,475; 5,512,667; 5,514,785; 5,565,552; 5,567,810; 5,574,142; 5,585,481; 5,587,371; 5,595,726; 5,597,696; 5,599,923; 5,599, 928 and 5,688,941.

Sugars and other moieties can be used to target proteins and complexes comprising nucleotides, such as cationic polysomes and liposomes, to particular sites. For example, hepatic cell directed transfer can be mediated via asialoglycoprotein receptors (ASGPRs); see, e.g., Hu, et al., Protein Pept Lett. 21(10):1025-30 (2014). Other systems known in the art and regularly developed can be used to target biomolecules of use in the present case and/or complexes thereof to particular target cells of interest.

These targeting moieties or conjugates can include conjugate groups covalently bound to functional groups, such as primary or secondary hydroxyl groups. Conjugate groups of the disclosure include intercalators, reporter molecules, polyamines, polyamides, polyethylene glycols, polyethers, groups that enhance the pharmacodynamic properties of oligomers, and groups that enhance the pharmacokinetic properties of oligomers. Typical conjugate groups include cholesterols, lipids, phospholipids, biotin, phenazine, folate, phenanthridine, anthraquinone, acridine, fluoresceins, rhodamines, coumarins, and dyes. Groups that enhance the pharmacodynamic properties, in the context of this disclosure, include groups that improve uptake, enhance resistance to degradation, and/or strengthen sequence-specific hybridization with the target nucleic acid. Groups that enhance the pharmacokinetic properties, in the context of this disclosure, include groups that improve uptake, distribution, metabolism or excretion of the compounds of the present disclosure. Representative conjugate groups are disclosed in International Patent Application No. PCT/US92/09196, filed Oct. 23, 1992, and U.S. Pat. No. 6,287,860, which are incorporated herein by reference. Conjugate moieties include, but are not limited to, lipid moieties such as a cholesterol moiety, cholic acid, a thioether, e.g., hexyl-5-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxy cholesterol moiety. See, e.g., U.S. Pat. Nos. 4,828,979; 4,948,882; 5,218,105; 5,525,465; 5,541,313; 5,545,730; 5,552,538; 5,578,717; 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203; 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941.

Longer polynucleotides that are less amenable to chemical synthesis and are typically produced by enzymatic synthesis can also be modified by various means. Such modifications can include, for example, the introduction of certain nucleotide analogs, the incorporation of particular sequences or other moieties at the 5' or 3' ends of molecules, and other modifications. By way of illustration, the mRNA encoding Cas9 is approximately 4 kb in length and can be synthesized by in vitro transcription. Modifications to the mRNA can be applied to, e.g., increase its translation or stability (such as by increasing its resistance to degradation with a cell), or to reduce the tendency of the RNA to elicit an innate immune response that is often observed in cells following introduction of exogenous RNAs, particularly longer RNAs such as that encoding Cas9.

Numerous such modifications have been described in the art, such as polyA tails, 5' cap analogs (e.g., Anti Reverse Cap Analog (ARCA) or m7G(5')ppp(5')G (mCAP)), modified 5' or 3' untranslated regions (UTRs), use of modified bases (such as Pseudo-UTP, 2-Thio-UTP, 5-Methylcytidine-5'-Triphosphate (5-Methyl-CTP) or N6-Methyl-ATP), or treatment with phosphatase to remove 5' terminal phosphates. These and other modifications are known in the art, and new modifications of RNAs are regularly being developed.

There are numerous commercial suppliers of modified RNAs, including for example, TriLink Biotech, AxoLabs, Bio-Synthesis Inc., Dharmacon and many others. As described by TriLink, for example, 5-Methyl-CTP can be used to impart desirable characteristics, such as increased nuclease stability, increased translation or reduced interaction of innate immune receptors with in vitro transcribed RNA. 5-Methylcytidine-5'-Triphosphate (5-Methyl-CTP), N6-Methyl-ATP, as well as Pseudo-UTP and 2-Thio-UTP, have also been shown to reduce innate immune stimulation in culture and in vivo while enhancing translation, as illustrated in publications by Kormann et al. and Warren et al. referred to below.

It has been shown that chemically modified mRNA delivered in vivo can be used to achieve improved therapeutic effects; see, e.g., Kormann et al., Nature Biotechnology 29, 154-157 (2011). Such modifications can be used, for example, to increase the stability of the RNA molecule and/or reduce its immunogenicity. Using chemical modifications such as Pseudo-U, N6-Methyl-A, 2-Thio-U and 5-Methyl-C, it was found that substituting just one quarter of the uridine and cytidine residues with 2-Thio-U and 5-Methyl-C respectively resulted in a significant decrease in toll-like receptor (TLR) mediated recognition of the mRNA in mice. By reducing the activation of the innate immune system, these modifications can be used to effectively increase the stability and longevity of the mRNA in vivo; see, e.g., Kormann et al., supra.

It has also been shown that repeated administration of synthetic messenger RNAs incorporating modifications designed to bypass innate anti-viral responses can reprogram differentiated human cells to pluripotency. See, e.g., Warren, et al., Cell Stem Cell, 7(5):618-30 (2010). Such modified mRNAs that act as primary reprogramming proteins can be an efficient means of reprogramming multiple human cell types. Such cells are referred to as induced pluripotency stem cells (iPSCs), and it was found that enzymatically synthesized RNA incorporating 5-Methyl-CTP, Pseudo-UTP and an Anti Reverse Cap Analog (ARCA) could be used to effectively evade the cell's antiviral response; see, e.g., Warren et al., supra.

Other modifications of polynucleotides described in the art include, for example, the use of polyA tails, the addition of 5' cap analogs (such as m7G(5')ppp(5')G (mCAP)), modifications of 5' or 3' untranslated regions (UTRs), or treatment with phosphatase to remove 5' terminal phosphates—and new approaches are regularly being developed.

A number of compositions and techniques applicable to the generation of modified RNAs for use herein have been developed in connection with the modification of RNA interference (RNAi), including small-interfering RNAs (siRNAs). siRNAs present particular challenges in vivo because their effects on gene silencing via mRNA interference are generally transient, which can require repeat administration. In addition, siRNAs are double-stranded RNAs (dsRNA) and mammalian cells have immune responses that have evolved to detect and neutralize dsRNA, which is often a by-product of viral infection. Thus, there are mammalian enzymes such as PKR (dsRNA-responsive kinase), and potentially retinoic acid-inducible gene I (RIG-I), that can mediate cellular responses to dsRNA, as well as Toll-like receptors (such as TLR3, TLR7 and TLR8) that can trigger the induction of cytokines in response to such molecules; see, e.g., the reviews by Angart et al., Pharmaceuticals (Basel) 6(4): 440-468 (2013); Kanasty et al., Molecular Therapy 20(3): 513-524 (2012); Burnett et al., Biotechnol J. 6(9):1130-46 (2011); Judge and MacLachlan, Hum Gene Ther 19(2):111-24 (2008); and references cited therein.

A large variety of modifications have been developed and applied to enhance RNA stability, reduce innate immune responses, and/or achieve other benefits that can be useful in connection with the introduction of polynucleotides into human cells, as described herein; see, e.g., the reviews by Whitehead K A et al., Annual Review of Chemical and Biomolecular Engineering, 2: 77-96 (2011); Gaglione and Messere, Mini Rev Med Chem, 10(7):578-95 (2010); Chernolovskaya et al, Curr Opin Mol Ther., 12(2):158-67 (2010); Deleavey et al., Curr Protoc Nucleic Acid Chem Chapter 16:Unit 16.3 (2009); Behlke, Oligonucleotides 18(4):305-19 (2008); Fucini et al., Nucleic Acid Ther 22(3): 205-210 (2012); Bremsen et al., Front Genet 3:154 (2012).

As noted above, there are a number of commercial suppliers of modified RNAs, many of which have specialized in modifications designed to improve the effectiveness of siRNAs. A variety of approaches are offered based on various findings reported in the literature. For example, Dharmacon notes that replacement of a non-bridging oxygen with sulfur (phosphorothioate, PS) has been extensively used to improve nuclease resistance of siRNAs, as reported by Kole, Nature Reviews Drug Discovery 11:125-140 (2012). Modifications of the 2'-position of the ribose have been reported to improve nuclease resistance of the internucleotide phosphate bond while increasing duplex stability (Tm), which has also been shown to provide protection from immune activation. A combination of moderate PS backbone modifications with small, well-tolerated 2'-substitutions (2'-O-Methyl, 2'-Fluoro, 2'-Hydro) have been associated with highly stable siRNAs for applications in vivo, as reported by Soutschek et al. Nature 432:173-178 (2004); and 2'-O-Methyl modifications have been reported to be effective in improving stability as reported by Volkov, Oligonucleotides 19:191-202 (2009). With respect to decreasing the induction of innate immune responses, modifying specific sequences with 2'-O-Methyl, 2'-Fluoro, 2'-Hydro have been reported to reduce TLR7/TLR8 interaction while generally preserving silencing activity; see, e.g., Judge et al., Mol. Ther. 13:494-505 (2006); and Cekaite et al., J. Mol. Biol. 365:90-108 (2007). Additional modifications, such as 2-thiouracil, pseudouracil, 5-methylcytosine, 5-methyluracil, and N6-methyladenosine have also been shown to minimize the immune effects mediated by TLR3, TLR7, and TLR8; see, e.g., Kariko, K. et al., Immunity 23:165-175 (2005).

As is also known in the art, and commercially available, a number of conjugates can be applied to polynucleotides, such as RNAs, for use herein that can enhance their delivery and/or uptake by cells, including for example, cholesterol, tocopherol and folic acid, lipids, peptides, polymers, linkers and aptamers; see, e.g., the review by Winkler, Ther. Deliv. 4:791-809 (2013), and references cited therein.

Codon-Optimization

In some embodiments, a polynucleotide encoding a site-directed polypeptide is codon-optimized according to methods standard in the art for expression in the cell containing the target DNA of interest. For example, if the intended target nucleic acid is in a human cell, a human codon-optimized polynucleotide encoding Cas9 is contemplated for use for producing the Cas9 polypeptide.

Complexes of a Genome-Targeting Nucleic Acid and a Site-Directed Polypeptide

A genome-targeting nucleic acid interacts with a site-directed polypeptide (e.g., a nucleic acid-guided nuclease such as Cas9), thereby forming a complex. The genome-targeting nucleic acid guides the site-directed polypeptide to a target nucleic acid.

RNPs

The site-directed polypeptide and genome-targeting nucleic acid may each be administered separately to a cell or a patient. On the other hand, the site-directed polypeptide may be pre-complexed with one or more guide RNAs, or one or more crRNA together with a tracrRNA. The pre-complexed material may then be administered to a cell or a patient. Such pre-complexed material is known as a ribonucleoprotein particle (RNP).

Nucleic Acids Encoding System Components

The present disclosure provides a nucleic acid comprising a nucleotide sequence encoding a genome-targeting nucleic acid of the disclosure, a site-directed polypeptide of the disclosure, and/or any nucleic acid or proteinaceous molecule necessary to carry out the aspects of the methods of the disclosure.

The nucleic acid encoding a genome-targeting nucleic acid of the disclosure, a site-directed polypeptide of the disclosure, and/or any nucleic acid or proteinaceous molecule necessary to carry out the aspects of the methods of the disclosure comprises a vector (e.g., a recombinant expression vector).

The term "vector" refers to a nucleic acid molecule capable of transporting another nucleic acid to which it has been linked. One type of vector is a "plasmid", which refers to a circular double-stranded DNA loop into which additional nucleic acid segments can be ligated. Another type of vector is a viral vector(e.g., AAV), wherein additional nucleic acid segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome.

In some embodiments, vectors are capable of directing the expression of nucleic acids to which they are operatively linked. Such vectors are referred to herein as "recombinant expression vectors", or more simply "expression vectors", which serve equivalent functions.

The term "operably linked" means that the nucleotide sequence of interest is linked to regulatory sequence(s) in a manner that allows for expression of the nucleotide sequence. The term "regulatory sequence" is intended to include, for example, promoters, enhancers and other expression control elements (e.g., polyadenylation signals). Such regulatory sequences are well known in the art and are described, for example, in Goeddel; Gene Expression Technology: Methods in Enzymology 185, Academic Press, San Diego, Calif. (1990). Regulatory sequences include those that direct constitutive expression of a nucleotide sequence in many types of host cells, and those that direct expression of the nucleotide sequence only in certain host cells (e.g., tissue-specific regulatory sequences). It will be appreciated by those skilled in the art that the design of the expression vector can depend on such factors as the choice of the target cell, the level of expression desired, and the like.

Expression vectors contemplated include, but are not limited to, viral vectors based on vaccinia virus, poliovirus, adenovirus, adeno-associated virus, SV40, herpes simplex virus, human immunodeficiency virus, retrovirus (e.g., Murine Leukemia Virus, spleen necrosis virus, and vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus) and other recombinant vectors. Other vectors contemplated for eukaryotic target cells include, but are not limited to, the vectors pXT1, pSG5, pSVK3, pBPV, pMSG, and pSVLSV40 (Pharmacia). Additional vectors contemplated for eukaryotic target cells include, but are not limited to, the vectors. Other vectors may be used so long as they are compatible with the host cell.

In some embodiments, a vector comprises one or more transcription and/or translation control elements. Depending on the host/vector system utilized, any of a number of suitable transcription and translation control elements, including constitutive and inducible promoters, transcription enhancer elements, transcription terminators, etc. may be used in the expression vector. In some embodiments, the vector is a self-inactivating vector that either inactivates the viral sequences or the components of the CRISPR machinery or other elements.

Non-limiting examples of suitable eukaryotic promoters (i.e., promoters functional in a eukaryotic cell) include those from cytomegalovirus (CMV) immediate early, herpes simplex virus (HSV) thymidine kinase, early and late SV40, long terminal repeats (LTRs) from retrovirus, human elongation factor-1 promoter (EF1), a hybrid construct comprising the cytomegalovirus (CMV) enhancer fused to the chicken beta-actin promoter (CAG), murine stem cell virus promoter (MSCV), phosphoglycerate kinase-1 locus promoter (PGK), and mouse metallothionein-I.

For expressing small RNAs, including guide RNAs used in connection with Cas endonuclease, various promoters such as RNA polymerase III promoters, including for example U6 and H1, can be advantageous. Descriptions of and parameters for enhancing the use of such promoters are known in art, and additional information and approaches are regularly being described; see, e.g., Ma, H. et al., *Molecular Therapy—Nucleic Acids* 3, e161 (2014) doi:10.1038/mtna.2014.12.

The expression vector may also contain a ribosome binding site for translation initiation and a transcription terminator. The expression vector may also comprise appropriate sequences for amplifying expression. The expression vector may also include nucleotide sequences encoding non-native tags (e.g., histidine tag, hemagglutinin tag, green fluorescent protein, etc.) that are fused to the site-directed polypeptide, thus resulting in a fusion protein.

In some embodiments, a promoter is an inducible promoter (e.g., a heat shock promoter, tetracycline-regulated promoter, steroid-regulated promoter, metal-regulated promoter, estrogen receptor-regulated promoter, etc.). In some embodiments, the promoter is a constitutive promoter (e.g., CMV promoter, UBC promoter). In some embodiments, the promoter is a spatially restricted and/or temporally restricted promoter (e.g., a tissue specific promoter, a cell type specific promoter, etc.).

In some embodiments, the nucleic acid encoding a genome-targeting nucleic acid of the disclosure and/or a site-directed polypeptide is packaged into or on the surface of delivery vehicles for delivery to cells. Delivery vehicles contemplated include, but are not limited to, nanospheres, liposomes, quantum dots, nanoparticles, polyethylene glycol particles, hydrogels, and micelles. As described in the art, a variety of targeting moieties can be used to enhance the preferential interaction of such vehicles with desired cell types or locations.

Introduction of the complexes, polypeptides, and nucleic acids of the disclosure into cells can occur by viral or bacteriophage infection, transfection, conjugation, protoplast fusion, lipofection, electroporation, nucleofection, calcium phosphate precipitation, polyethyleneimine (PEI)-mediated transfection, DEAE-dextran mediated transfection, liposome-mediated transfection, particle gun technology, calcium phosphate precipitation, direct micro-injection, nanoparticle-mediated nucleic acid delivery, and the like.

Delivery

Guide RNA polynucleotides (RNA or DNA) and/or endonuclease polynucleotide(s) (RNA or DNA) can be delivered by viral or non-viral delivery vehicles known in the art. Alternatively, endonuclease polypeptide(s) may be delivered by viral or non-viral delivery vehicles known in the art, such as electroporation or lipid nanoparticles. In some embodiments, the DNA endonuclease may be delivered as one or more polypeptides, either alone or pre-complexed with one or more guide RNAs, or one or more crRNA together with a tracrRNA.

Polynucleotides may be delivered by non-viral delivery vehicles including, but not limited to, nanoparticles, liposomes, ribonucleoproteins, positively charged peptides, small molecule RNA-conjugates, aptamer-RNA chimeras, and RNA-fusion protein complexes. Some exemplary non-viral delivery vehicles are described in Peer and Lieberman, Gene Therapy, 18: 1127-1133 (2011) (which focuses on non-viral delivery vehicles for siRNA that are also useful for delivery of other polynucleotides).

Polynucleotides, such as guide RNA, sgRNA, and mRNA encoding an endonuclease, may be delivered to a cell or a patient by a lipid nanoparticle (LNP).

A LNP refers to any particle having a diameter of less than 1000 nm, 500 nm, 250 nm, 200 nm, 150 nm, 100 nm, 75 nm, 50 nm, or 25 nm. Alternatively, a nanoparticle may range in size from 1-1000 nm, 1-500 nm, 1-250 nm, 25-200 nm, 25-100 nm, 35-75 nm, or 25-60 nm.

LNPs may be made from cationic, anionic, or neutral lipids. Neutral lipids, such as the fusogenic phospholipid DOPE or the membrane component cholesterol, may be included in LNPs as 'helper lipids' to enhance transfection activity and nanoparticle stability. Limitations of cationic lipids include low efficacy owing to poor stability and rapid clearance, as well as the generation of inflammatory or anti-inflammatory responses.

LNPs may also be comprised of hydrophobic lipids, hydrophilic lipids, or both hydrophobic and hydrophilic lipids.

Any lipid or combination of lipids that are known in the art may be used to produce a LNP. Examples of lipids used to produce LNPs are: DOTMA, DOSPA, DOTAP, DMRIE, DC-cholesterol, DOTAP-cholesterol, GAP-DMORIE-DPyPE, and GL67A-DOPE-DMPE-polyethylene glycol (PEG). Examples of cationic lipids are: 98N12-5, C12-200, DLin-KC2-DMA (KC2), DLin-MC3-DMA (MC3), XTC, MD1, and 7C1. Examples of neutral lipids are: DPSC, DPPC, POPC, DOPE, and SM. Examples of PEG-modified lipids are: PEG-DMG, PEG-CerC14, and PEG-CerC20.

The lipids may be combined in any number of molar ratios to produce a LNP. In addition, the polynucleotide(s) may be combined with lipid(s) in a wide range of molar ratios to produce a LNP.

As stated previously, the site-directed polypeptide and genome-targeting nucleic acid may each be administered separately to a cell or a patient. On the other hand, the site-directed polypeptide may be pre-complexed with one or more guide RNAs, or one or more crRNA together with a tracrRNA. The pre-complexed material may then be administered to a cell or a patient. Such pre-complexed material is known as a ribonucleoprotein particle (RNP).

RNA is capable of forming specific interactions with RNA or DNA. While this property is exploited in many biological processes, it also comes with the risk of promiscuous interactions in a nucleic acid-rich cellular environment. One solution to this problem is the formation of ribonucleoprotein particles (RNPs), in which the RNA is pre-complexed with an endonuclease. Another benefit of the RNP is protection of the RNA from degradation.

The endonuclease in the RNP may be modified or unmodified. Likewise, the gRNA, crRNA, tracrRNA, or sgRNA may be modified or unmodified. Numerous modifications are known in the art and may be used.

The endonuclease and sgRNA may be generally combined in a 1:1 molar ratio. Alternatively, the endonuclease, crRNA and tracrRNA may be generally combined in a 1:1:1 molar ratio. However, a wide range of molar ratios may be used to produce a RNP.

A recombinant adeno-associated virus (AAV) vector may be used for delivery. Techniques to produce rAAV particles, in which an AAV genome to be packaged that includes the polynucleotide to be delivered, rep and cap genes, and helper virus functions are provided to a cell are standard in the art. Production of rAAV requires that the following components are present within a single cell (denoted herein as a packaging cell): a rAAV genome, AAV rep and cap genes separate from (i.e., not in) the rAAV genome, and helper virus functions. The AAV rep and cap genes may be from any AAV serotype for which recombinant virus can be derived, and may be from a different AAV serotype than the rAAV genome ITRs, including, but not limited to, AAV serotypes AAV-1, AAV-2, AAV-3, AAV-4, AAV-5, AAV-6, AAV-7, AAV-8, AAV-9, AAV-10, AAV-11, AAV-12, AAV-13 and AAV rh.74. Production of pseudotyped rAAV is disclosed in, for example, international patent application publication number WO 01/83692. See Table 2.

TABLE 2

| AAV Serotype | Genbank Accession No. |
| --- | --- |
| AAV-1 | NC_002077.1 |
| AAV-2 | NC_001401.2 |
| AAV-3 | NC_001729.1 |
| AAV-3B | AF028705.1 |
| AAV-4 | NC_001829.1 |
| AAV-5 | NC_006152.1 |
| AAV-6 | AF028704.1 |
| AAV-7 | NC_006260.1 |
| AAV-8 | NC_006261.1 |
| AAV-9 | AX753250.1 |
| AAV-10 | AY631965.1 |
| AAV-11 | AY631966.1 |

TABLE 2-continued

| AAV Serotype | Genbank Accession No. |
| --- | --- |
| AAV-12 | DQ813647.1 |
| AAV-13 | EU285562.1 |

A method of generating a packaging cell involves creating a cell line that stably expresses all of the necessary components for AAV particle production. For example, a plasmid (or multiple plasmids) comprising a rAAV genome lacking AAV rep and cap genes, AAV rep and cap genes separate from the rAAV genome, and a selectable marker, such as a neomycin resistance gene, are integrated into the genome of a cell. AAV genomes have been introduced into bacterial plasmids by procedures such as GC tailing (Samulski et al., 1982, Proc. Natl. Acad. S6. USA, 79:2077-2081), addition of synthetic linkers containing restriction endonuclease cleavage sites (Laughlin et al., 1983, Gene, 23:65-73) or by direct, blunt-end ligation (Senapathy & Carter, 1984, J. Biol. Chem., 259:4661-4666). The packaging cell line is then infected with a helper virus, such as adenovirus. The advantages of this method are that the cells are selectable and are suitable for large-scale production of rAAV. Other examples of suitable methods employ adenovirus or baculovirus, rather than plasmids, to introduce rAAV genomes and/or rep and cap genes into packaging cells.

General principles of rAAV production are reviewed in, for example, Carter, 1992, Current Opinions in Biotechnology, 1533-539; and Muzyczka, 1992, Curr. Topics in Microbial. and Immunol., 158:97-129). Various approaches are described in Ratschin et al., Mol. Cell. Biol. 4:2072 (1984); Hermonat et al., Proc. Natl. Acad. Sci. USA, 81:6466 (1984); Tratschin et al., Mol. Cell. Biol. 5:3251 (1985); McLaughlin et al., J. Virol., 62:1963 (1988); and Lebkowski et al., 1988 Mol. Cell. Biol., 7:349 (1988). Samulski et al. (1989, J. Virol., 63:3822-3828); U.S. Pat. No. 5,173,414; WO 95/13365 and corresponding U.S. Pat. No. 5,658.776; WO 95/13392; WO 96/17947; PCT/US98/18600; WO 97/09441 (PCT/US96/14423); WO 97/08298 (PCT/US96/13872); WO 97/21825 (PCT/US96/20777); WO 97/06243 (PCT/FR96/01064); WO 99/11764; Perrin et al. (1995) Vaccine 13:1244-1250; Paul et al. (1993) Human Gene Therapy 4:609-615; Clark et al. (1996) Gene Therapy 3:1124-1132; U.S. Pat. Nos. 5,786,211; 5,871,982; and 6,258,595.

AAV vector serotypes can be matched to target cell types. For example, the following exemplary cell types may be transduced by the indicated AAV serotypes among others. See Table 3.

TABLE 3

| Tissue/Cell Type | Serotype |
| --- | --- |
| Liver | AAV3, AAV5, AAV8, AAV9 |
| Skeletal muscle | AAV1, AAV7, AAV6, AAV8, AAV9 |
| Central nervous system | AAV5, AAV1, AAV4 |
| RPE | AAV5, AAV4 |
| Photoreceptor cells | AAV5 |
| Lung | AAV9 |
| Heart | AAV8 |
| Pancreas | AAV8 |
| Kidney | AAV2, AAV8 |
| Hematopoietic stem cells | AAV6 |

In addition to adeno-associated viral vectors, other viral vectors can be used. Such viral vectors include, but are not limited to, lentivirus, alphavirus, enterovirus, pestivirus, baculovirus, herpesvirus, Epstein Barr virus, papovavirusr, poxvirus, vaccinia virus, and herpes simplex virus.

In some embodiments, Cas9 mRNA, sgRNA targeting one or two loci in target gene, and donor DNA is each separately formulated into lipid nanoparticles, or are all co-formulated into one lipid nanoparticle, or co-formulated into two or more lipid nanoparticles.

In some embodiments, Cas9 mRNA is formulated in a lipid nanoparticle, while sgRNA and donor DNA are delivered in an AAV vector. In some embodiments, Cas9 mRNA and sgRNA are co-formulated in a lipid nanoparticle, while donor DNA is delivered in an AAV vector.

Options are available to deliver the Cas9 nuclease as a DNA plasmid, as mRNA or as a protein. The guide RNA can be expressed from the same DNA, or can also be delivered as an RNA. The RNA can be chemically modified to alter or improve its half-life, or decrease the likelihood or degree of immune response. The endonuclease protein can be complexed with the gRNA prior to delivery. Viral vectors allow efficient delivery; split versions of Cas9 and smaller orthologs of Cas9 can be packaged in AAV, as can donors for HDR. A range of non-viral delivery methods also exist that can deliver each of these components, or non-viral and viral methods can be employed in tandem. For example, nanoparticles can be used to deliver the protein and guide RNA, while AAV can be used to deliver a donor DNA.

Exosomes

Exosomes, a type of microvesicle bound by phospholipid bilayer, can be used to deliver nucleic acids to specific tissue. Many different types of cells within the body naturally secrete exosomes. Exosomes form within the cytoplasm when endosomes invaginate and form multivesicular-endosomes (MVE). When the MVE fuses with the cellular membrane, the exosomes are secreted in the extracellular space. Ranging between 30-120 nm in diameter, exosomes can shuttle various molecules from one cell to another in a form of cell-to-cell communication. Cells that naturally produce exosomes, such as mast cells, can be genetically altered to produce exosomes with surface proteins that target specific tissues, alternatively exosomes can be isolated from the bloodstream. Specific nucleic acids can be placed within the engineered exosomes with electroporation. When introduced systemically, the exosomes can deliver the nucleic acids to the specific target tissue.

Genetically Modified Cells

The term "genetically modified cell" refers to a cell that comprises at least one genetic modification introduced by genome editing (e.g., using the CRISPR/Cas9/Cpf1 system). In some examples, (e.g., ex vivo examples) herein, the genetically modified cell is genetically modified progenitor cell. In some examples herein, the genetically modified cell is genetically modified T cell. A genetically modified cell comprising an exogenous genome-targeting nucleic acid and/or an exogenous nucleic acid encoding a genome-targeting nucleic acid is contemplated herein.

The term "control treated population" describes a population of cells that has been treated with identical media, viral induction, nucleic acid sequences, temperature, confluency, flask size, pH, etc., with the exception of the addition of the genome editing components. Any method known in the art can be used to measure restoration of target gene or protein expression or activity, for example Western Blot analysis of the target protein or quantifying target mRNA.

The term "isolated cell" refers to a cell that has been removed from an organism in which it was originally found, or a descendant of such a cell. Optionally, the cell is cultured in vitro, e.g., under defined conditions or in the presence of other cells. Optionally, the cell is later introduced into a second organism or re-introduced into the organism from which it (or the cell from which it is descended) was isolated.

The term "isolated population" with respect to an isolated population of cells refers to a population of cells that has been removed and separated from a mixed or heterogeneous population of cells. In some embodiments, the isolated population is a substantially pure population of cells, as compared to the heterogeneous population from which the cells were isolated or enriched. In some embodiments, the isolated population is an isolated population of human progenitor cells, e.g., a substantially pure population of human progenitor cells, as compared to a heterogeneous population of cells comprising human progenitor cells and cells from which the human progenitor cells were derived.

The term "substantially enhanced," with respect to a particular cell population, refers to a population of cells in which the occurrence of a particular type of cell is increased relative to pre-existing or reference levels, by at least 2-fold, at least 3-, at least 4-, at least 5-, at least 6-, at least 7-, at least 8-, at least 9, at least 10-, at least 20-, at least 50-, at least 100-, at least 400-, at least 1000-, at least 5000-, at least 20000-, at least 100000- or more fold depending, e.g., on the desired levels of such cells for ameliorating a medical condition.

The term "substantially enriched" with respect to a particular cell population, refers to a population of cells that is at least about 10%, about 20%, about 30%, about 40%, about 50%, about 60%, about 70% or more with respect to the cells making up a total cell population.

The terms "substantially enriched" or "substantially pure" with respect to a particular cell population, refers to a population of cells that is at least about 75%, at least about 85%, at least about 90%, or at least about 95% pure, with respect to the cells making up a total cell population. That is, the terms "substantially pure" or "essentially purified," with regard to a population of progenitor cells, refers to a population of cells that contain fewer than about 20%, about 15%, about 10%, about 9%, about 8%, about 7%, about 6%, about 5%, about 4%, about 3%, about 2%, about 1%, or less than 1%, of cells that are not progenitor cells as defined by the terms herein.

Implanting Cells into Patients

Another step of the ex vivo methods of the present disclosure comprises implanting the cells into patients. This implanting step may be accomplished using any method of implantation known in the art. For example, the genetically modified cells may be injected directly in the patient's blood or otherwise administered to the patient. The genetically modified cells may be purified ex vivo using a selected marker.

Pharmaceutically Acceptable Carriers

The ex vivo methods of administering progenitor cells to a subject contemplated herein involve the use of therapeutic compositions comprising progenitor cells.

Therapeutic compositions contain a physiologically tolerable carrier together with the cell composition, and optionally at least one additional bioactive agent as described herein, dissolved or dispersed therein as an active ingredient. In some embodiments, the therapeutic composition is not substantially immunogenic when administered to a mammal or human patient for therapeutic purposes, unless so desired.

In general, the progenitor cells described herein are administered as a suspension with a pharmaceutically acceptable carrier. One of skill in the art will recognize that a pharmaceutically acceptable carrier to be used in a cell composition will not include buffers, compounds, cryopreservation agents, preservatives, or other agents in amounts that substantially interfere with the viability of the cells to be delivered to the subject. A formulation comprising cells can include e.g., osmotic buffers that permit cell membrane integrity to be maintained, and optionally, nutrients to maintain cell viability or enhance engraftment upon administration. Such formulations and suspensions are known to those of skill in the art and/or can be adapted for use with the progenitor cells, as described herein, using routine experimentation.

A cell composition can also be emulsified or presented as a liposome composition, provided that the emulsification procedure does not adversely affect cell viability. The cells and any other active ingredient can be mixed with excipients that are pharmaceutically acceptable and compatible with the active ingredient, and in amounts suitable for use in the therapeutic methods described herein.

Additional agents included in a cell composition can include pharmaceutically acceptable salts of the components therein. Pharmaceutically acceptable salts include the acid addition salts (formed with the free amino groups of the polypeptide) that are formed with inorganic acids, such as, for example, hydrochloric or phosphoric acids, or such organic acids as acetic, tartaric, mandelic and the like. Salts formed with the free carboxyl groups can also be derived from inorganic bases, such as, for example, sodium, potassium, ammonium, calcium or ferric hydroxides, and such organic bases as isopropylamine, trimethylamine, 2-ethylamino ethanol, histidine, procaine and the like.

Physiologically tolerable carriers are well known in the art. Exemplary liquid carriers are sterile aqueous solutions that contain no materials in addition to the active ingredients and water, or contain a buffer such as sodium phosphate at physiological pH value, physiological saline or both, such as phosphate-buffered saline. Still further, aqueous carriers can contain more than one buffer salt, as well as salts such as sodium and potassium chlorides, dextrose, polyethylene glycol and other solutes. Liquid compositions can also contain liquid phases in addition to and to the exclusion of water. Exemplary of such additional liquid phases are glycerin, vegetable oils such as cottonseed oil, and water-oil emulsions. The amount of an active compound used in the cell compositions that is effective in the treatment of a particular disorder or condition will depend on the nature of the disorder or condition, and can be determined by standard clinical techniques.

Administration & Efficacy

The terms "administering," "introducing" and "transplanting" are used interchangeably in the context of the placement of cells, e.g., progenitor cells, into a subject, by a method or route that results in at least partial localization of the introduced cells at a desired site, such as a site of injury or repair, such that a desired effect(s) is produced. The cells e.g., progenitor cells, or their differentiated progeny can be administered by any appropriate route that results in delivery to a desired location in the subject where at least a portion of the implanted cells or components of the cells remain viable. The period of viability of the cells after administration to a subject can be as short as a few hours, e.g., twenty-four hours, to a few days, to as long as several years, or even the life time of the patient, i.e., long-term engraftment. For example, in some aspects described herein, an effective amount of myogenic progenitor cells is administered via a systemic route of administration, such as an intraperitoneal or intravenous route.

The terms "individual", "subject," "host" and "patient" are used interchangeably herein and refer to any subject for whom diagnosis, treatment or therapy is desired. In some aspects, the subject is a mammal. In some aspects, the subject is a human being.

The term "donor" is used to refer to an individual that is not the patient. In some embodiments, the donor is an individual who does not have or is not suspected of having the medical condition to be treated. In some embodiments, multiple donors, e.g., two or more donors, can be used. In some embodiments, each donor used is an individual who does not have or is not suspected of having the medical condition to be treated.

When provided prophylactically, progenitor cells described herein can be administered to a subject in advance of any symptom of a medical condition, e.g., prior to the development of alpha/beta T-cell lymphopenia with gamma/delta T-cell expansion, severe cytomegalovirus (CMV) infection, autoimmunity, chronic inflammation of the skin, eosinophilia, failure to thrive, swollen lymph nodes, swollen spleen, diarrhea and enlarged liver. Accordingly, the prophylactic administration of a hematopoietic progenitor cell population serves to prevent a medical condition.

When provided therapeutically, hematopoietic progenitor cells are provided at (or after) the onset of a symptom or indication of a medical condition, e.g., upon the onset of disease.

In some embodiments, the T cell population being administered according to the methods described herein comprises allogeneic T cells obtained from one or more donors. In some embodiments, the cell population being administered can be allogeneic blood cells, hematopoietic stem cells, hematopoietic progenitor cells, embryonic stem cells, or induced embryonic stem cells. "Allogeneic" refers to a cell, cell population, or biological samples comprising cells, obtained from one or more different donors of the same species, where the genes at one or more loci are not identical to the recipient. For example, a hematopoietic progenitor cell population, or T cell population, being administered to a subject can be derived from one or more unrelated donors, or from one or more non-identical siblings. In some embodiments, syngeneic cell populations may be used, such as those obtained from genetically identical donors, (e.g., identical twins). In some embodiments, the cells are autologous cells; that is, the cells (e.g.: hematopoietic progenitor cells, or T cells) are obtained or isolated from a subject and administered to the same subject, i.e., the donor and recipient are the same.

The term "effective amount" refers to the amount of a population of progenitor cells or their progeny needed to prevent or alleviate at least one or more signs or symptoms of a medical condition, and relates to a sufficient amount of a composition to provide the desired effect, e.g., to treat a subject having a medical condition. The term "therapeutically effective amount" therefore refers to an amount of progenitor cells or a composition comprising progenitor cells that is sufficient to promote a particular effect when administered to a typical subject, such as one who has or is at risk for a medical condition. An effective amount would also include an amount sufficient to prevent or delay the development of a symptom of the disease, alter the course of a symptom of the disease (for example but not limited to, slow the progression of a symptom of the disease), or reverse a symptom of the disease. It is understood that for any given case, an appropriate "effective amount" can be determined by one of ordinary skill in the art using routine experimentation.

For use in the various aspects described herein, an effective amount of progenitor cells comprises at least $10^2$ progenitor cells, at least $5\times10^2$ progenitor cells, at least $10^3$ progenitor cells, at least $5\times10^3$ progenitor cells, at least $10^4$ progenitor cells, at least $5\times10^4$ progenitor cells, at least $10^5$ progenitor cells, at least $2\times10^5$ progenitor cells, at least $3\times10^5$ progenitor cells, at least $4\times10^5$ progenitor cells, at least $5\times10^5$ progenitor cells, at least $6\times10^5$ progenitor cells, at least $7\times10^5$ progenitor cells, at least $8\times10^5$ progenitor cells, at least $9\times10^5$ progenitor cells, at least $1\times10^6$ progenitor cells, at least $2\times10^6$ progenitor cells, at least $3\times10^6$ progenitor cells, at least $4\times10^6$ progenitor cells, at least $5\times10^6$ progenitor cells, at least $6\times10^6$ progenitor cells, at least $7\times10^6$ progenitor cells, at least $8\times10^6$ progenitor cells, at least $9\times10^6$ progenitor cells, or multiples thereof. The progenitor cells are derived from one or more donors, or are obtained from an autologous source. In some examples described herein, the progenitor cells are expanded in culture prior to administration to a subject in need thereof.

Modest and incremental increases in the levels of functional target expressed in cells of patients having a medical condition can be beneficial for ameliorating one or more symptoms of the disease, for increasing long-term survival, and/or for reducing side effects associated with other treatments. Upon administration of such cells to human patients, the presence of hematopoietic progenitors that are producing increased levels of functional target is beneficial. In some embodiments, effective treatment of a subject gives rise to at least about 3%, 5% or 7% functional target relative to total target in the treated subject. In some embodiments, functional target will be at least about 10% of total target. In some embodiments, functional target will be at least about 20% to 30% of total target. Similarly, the introduction of even relatively limited subpopulations of cells having significantly elevated levels of functional target can be beneficial in various patients because in some situations normalized cells will have a selective advantage relative to diseased cells. However, even modest levels of hematopoietic progenitors with elevated levels of functional target can be beneficial for ameliorating one or more aspects of a medical condition in patients. In some embodiments, about 10%, about 20%, about 30%, about 40%, about 50%, about 60%, about 70%, about 80%, about 90% or more of the hematopoietic progenitors in patients to whom such cells are administered are producing increased levels of functional target.

"Administered" refers to the delivery of a progenitor cell composition into a subject by a method or route that results in at least partial localization of the cell composition at a desired site. A cell composition can be administered by any appropriate route that results in effective treatment in the subject, i.e. administration results in delivery to a desired location in the subject where at least a portion of the composition delivered, i.e. at least $1\times10^4$ cells are delivered to the desired site for a period of time. Modes of administration include injection, infusion, instillation, or ingestion. "Injection" includes, without limitation, intravenous, intramuscular, intra-arterial, intrathecal, intraventricular, intracapsular, intraorbital, intracardiac, intradermal, intraperitoneal, transtracheal, subcutaneous, subcuticular, intraarticular, sub capsular, subarachnoid, intraspinal, intracerebro spinal, and intrasternal injection and infusion. In some embodiments, the route is intravenous. For the delivery of cells, administration by injection or infusion can be made.

The cells are administered systemically. The phrases "systemic administration," "administered systemically", "peripheral administration" and "administered peripherally" refer to the administration of a population of progenitor cells other than directly into a target site, tissue, or organ, such that it enters, instead, the subject's circulatory system and, thus, is subject to metabolism and other like processes.

The efficacy of a treatment comprising a composition for the treatment of a medical condition can be determined by the skilled clinician. However, a treatment is considered "effective treatment," if any one or all of the signs or symptoms of, as but one example, levels of functional target are altered in a beneficial manner (e.g., increased by at least 10%), or other clinically accepted symptoms or markers of disease are improved or ameliorated. Efficacy can also be measured by failure of an individual to worsen as assessed by hospitalization or need for medical interventions (e.g., progression of the disease is halted or at least slowed). Methods of measuring these indicators are known to those of skill in the art and/or described herein. Treatment includes any treatment of a disease in an individual or an animal (some non-limiting examples include a human, or a mammal) and includes: (1) inhibiting the disease, e.g., arresting, or slowing the progression of symptoms; or (2) relieving the disease, e.g., causing regression of symptoms; and (3) preventing or reducing the likelihood of the development of symptoms.

The treatment according to the present disclosure ameliorates one or more symptoms associated with a medical condition by increasing the amount of functional target in the individual. Early signs typically associated with a medical condition include for example, development of alpha/beta T-cell lymphopenia with gamma/delta T-cell expansion, severe cytomegalovirus (CMV) infection, autoimmunity, chronic inflammation of the skin, eosinophilia, failure to thrive, swollen lymph nodes, swollen spleen, diarrhea and enlarged liver.

Kits

The present disclosure provides kits for carrying out the methods described herein. A kit can include one or more of a genome-targeting nucleic acid, a polynucleotide encoding a genome-targeting nucleic acid, a site-directed polypeptide, a polynucleotide encoding a site-directed polypeptide, and/or any nucleic acid or proteinaceous molecule necessary to carry out the aspects of the methods described herein, or any combination thereof.

In some embodiments, a kit comprises: (1) a vector comprising a nucleotide sequence encoding a genome-targeting nucleic acid, (2) the site-directed polypeptide or a vector comprising a nucleotide sequence encoding the site-directed polypeptide, and (3) a reagent for reconstitution and/or dilution of the vector(s) and or polypeptide.

In some embodiments, a kit comprises: (1) a vector comprising (i) a nucleotide sequence encoding a genome-targeting nucleic acid, and (ii) a nucleotide sequence encoding the site-directed polypeptide; and (2) a reagent for reconstitution and/or dilution of the vector.

In some embodiments of any of the above kits, the kit comprises a single-molecule guide genome-targeting nucleic acid. In some embodiments of any of the above kits, the kit comprises a double-molecule genome-targeting nucleic acid. In some embodiments of any of the above kits, the kit comprises two or more double-molecule guides or single-molecule guides. In some embodiments, the kits comprise a vector that encodes the nucleic acid targeting nucleic acid.

In any of the above kits, the kit further comprises a polynucleotide to be inserted to affect the desired genetic modification.

Components of a kit may be in separate containers, or combined in a single container.

Any kit described above can further comprise one or more additional reagents, where such additional reagents are selected from a buffer, a buffer for introducing a polypeptide or polynucleotide into a cell, a wash buffer, a control reagent, a control vector, a control RNA polynucleotide, a reagent for in vitro production of the polypeptide from DNA, adaptors for sequencing and the like. A buffer can be a stabilization buffer, a reconstituting buffer, a diluting buffer, or the like. In some embodiments, a kit also comprises one or more components that can be used to facilitate or enhance the on-target binding or the cleavage of DNA by the endonuclease, or improve the specificity of targeting.

In addition to the above-mentioned components, a kit further comprises instructions for using the components of the kit to practice the methods. The instructions for practicing the methods are generally recorded on a suitable recording medium. For example, the instructions may be printed on a substrate, such as paper or plastic, etc. The instructions nay be present in the kits as a package insert, in the labeling of the container of the kit or components thereof (i.e., associated with the packaging or subpackaging), etc. The instructions can be present as an electronic storage data file present on a suitable computer readable storage medium, e.g. CD-ROM, diskette, flash drive, etc. In some instances, the actual instructions are not present in the kit, but means for obtaining the instructions from a remote source (e.g. via the Internet), can be provided. An example of this case is a kit that comprises a web address where the instructions can be viewed and/or from which the instructions can be downloaded. As with the instructions, this means for obtaining the instructions can be recorded on a suitable substrate.

Guide RNA Formulation

Guide RNAs of the present disclosure are formulated with pharmaceutically acceptable excipients such as carriers, solvents, stabilizers, adjuvants, diluents, etc., depending upon the particular mode of administration and dosage form. Guide RNA compositions are generally formulated to achieve a physiologically compatible pH, and range from a pH of about 3 to a pH of about 11, about pH 3 to about pH 7, depending on the formulation and route of administration. In some embodiments, the pH is adjusted to a range from about pH 5.0 to about pH 8. In some embodiments, the compositions comprise a therapeutically effective amount of at least one compound as described herein, together with one or more pharmaceutically acceptable excipients. Optionally, the compositions comprise a combination of the compounds described herein, or may include a second active ingredient useful in the treatment or prevention of bacterial growth (for example and without limitation, anti-bacterial or anti-microbial agents), or may include a combination of reagents of the present disclosure.

Suitable excipients include, for example, carrier molecules that include large, slowly metabolized macromolecules such as proteins, polysaccharides, polylactic acids, polyglycolic acids, polymeric amino acids, amino acid copolymers, and inactive virus particles. Other exemplary excipients can include antioxidants (for example and without limitation, ascorbic acid), chelating agents (for example and without limitation, EDTA), carbohydrates (for example and without limitation, dextrin, hydroxyalkylcellulose, and hydroxyalkylmethylcellulose), stearic acid, liquids (for example and without limitation, oils, water, saline, glycerol and ethanol), wetting or emulsifying agents, pH buffering substances, and the like.

Other Possible Therapeutic Approaches

Gene editing can be conducted using nucleases engineered to target specific sequences. To date there are four major types of nucleases: meganucleases and their derivatives, zinc finger nucleases (ZFNs), transcription activator like effector nucleases (TALENs), and CRISPR-Cas9 nuclease systems. The nuclease platforms vary in difficulty of design, targeting density and mode of action, particularly as the specificity of ZFNs and TALENs is through protein-DNA interactions, while RNA-DNA interactions primarily guide Cas9. Cas9 cleavage also requires an adjacent motif, the PAM, which differs between different CRISPR systems. Cas9 from Streptococcus pyogenes cleaves using a NRG PAM, CRISPR from Neisseria meningitidis can cleave at sites with PAMs including NNNNGATT, NNNNNGTTT and NNNNGCTT. A number of other Cas9 orthologs target protospacer adjacent to alternative PAMs.

CRISPR endonucleases, such as Cas9, can be used in the methods of the present disclosure. However, the teachings described herein, such as therapeutic target sites, could be applied to other forms of endonucleases, such as ZFNs, TALENs, HEs, or MegaTALs, or using combinations of nucleases. However, in order to apply the teachings of the present disclosure to such endonucleases, one would need to, among other things, engineer proteins directed to the specific target sites.

Additional binding domains may be fused to the Cas9 protein to increase specificity. The target sites of these constructs would map to the identified gRNA specified site, but would require additional binding motifs, such as for a zinc finger domain. In the case of Mega-TAL, a meganuclease can be fused to a TALE DNA-binding domain. The meganuclease domain can increase specificity and provide the cleavage. Similarly, inactivated or dead Cas9 (dCas9) can be fused to a cleavage domain and require the sgRNA/Cas9 target site and adjacent binding site for the fused DNA-binding domain. This likely would require some protein engineering of the dCas9, in addition to the catalytic inactivation, to decrease binding without the additional binding site.

Zinc Finger Nucleases

Zinc finger nucleases (ZFNs) are modular proteins comprised of an engineered zinc finger DNA binding domain linked to the catalytic domain of the type II endonuclease FokI. Because FokI functions only as a dimer, a pair of ZFNs must be engineered to bind to cognate target "half-site" sequences on opposite DNA strands and with precise spacing between them to enable the catalytically active FokI dimer to form. Upon dimerization of the FokI domain, which itself has no sequence specificity per se, a DNA double-strand break is generated between the ZFN half-sites as the initiating step in genome editing.

The DNA binding domain of each ZFN is typically comprised of 3-6 zinc fingers of the abundant Cys2-His2 architecture, with each finger primarily recognizing a triplet of nucleotides on one strand of the target DNA sequence, although cross-strand interaction with a fourth nucleotide also can be important. Alteration of the amino acids of a finger in positions that make key contacts with the DNA alters the sequence specificity of a given finger. Thus, a four-finger zinc finger protein will selectively recognize a 12 bp target sequence, where the target sequence is a composite of the triplet preferences contributed by each finger, although triplet preference can be influenced to varying degrees by neighboring fingers. An important aspect of ZFNs is that they can be readily re-targeted to almost any genomic address simply by modifying individual fingers, although considerable expertise is required to do this well. In most applications of ZFNs, proteins of 4-6 fingers are used, recognizing 12-18 bp respectively. Hence, a pair of ZFNs will typically recognize a combined target sequence of 24-36 bp, not including the 5-7 bp spacer between half-sites. The binding sites can be separated further with larger spacers, including 15-17 bp. A target sequence of this length is likely to be unique in the human genome, assuming repetitive sequences or gene homologs are excluded during the design process. Nevertheless, the ZFN protein-DNA interactions are not absolute in their specificity so off-target binding and cleavage events do occur, either as a heterodimer between the two ZFNs, or as a homodimer of one or the other of the ZFNs. The latter possibility has been effectively eliminated by engineering the dimerization interface of the FokI domain to create "plus" and "minus" variants, also known as obligate heterodimer variants, which can only dimerize with each other, and not with themselves. Forcing the obligate heterodimer prevents formation of the homodimer. This has greatly enhanced specificity of ZFNs, as well as any other nuclease that adopts these FokI variants.

A variety of ZFN-based systems have been described in the art, and modifications thereof are regularly reported, and numerous references describe rules and parameters that are used to guide the design of ZFNs; see, e.g., Segal et al., *Proc Natl Acad Sci USA* 96(6):2758-63 (1999); Dreier B et al., *J Mol Biol.* 303(4):489-502 (2000); Liu Q et al., *J Biol Chem.* 277(6):3850-6 (2002); Dreier et al., *J Biol Chem* 280(42): 35588-97 (2005); and Dreier et al., *J Biol Chem.* 276(31): 29466-78 (2001).

Transcription Activator-Like Effector Nucleases (TALENs)

TALENs represent another format of modular nucleases whereby, as with ZFNs, an engineered DNA binding domain is linked to the FokI nuclease domain, and a pair of TALENs operate in tandem to achieve targeted DNA cleavage. The major difference from ZFNs is the nature of the DNA binding domain and the associated target DNA sequence recognition properties. The TALEN DNA binding domain derives from TALE proteins, which were originally described in the plant bacterial pathogen Xanthomonas sp. TALEs are comprised of tandem arrays of 33-35 amino acid repeats, with each repeat recognizing a single basepair in the target DNA sequence that is typically up to 20 bp in length, giving a total target sequence length of up to 40 bp. Nucleotide specificity of each repeat is determined by the repeat variable diresidue (RVD), which includes just two amino acids at positions 12 and 13. The bases guanine, adenine, cytosine and thymine are predominantly recognized by the four RVDs: Asn-Asn, Asn-Ile, His-Asp and Asn-Gly, respectively. This constitutes a much simpler recognition code than for zinc fingers, and thus represents an advantage over the latter for nuclease design. Nevertheless, as with ZFNs, the protein-DNA interactions of TALENs are not absolute in their specificity, and TALENs have also benefitted from the use of obligate heterodimer variants of the FokI domain to reduce off-target activity.

Additional variants of the FokI domain have been created that are deactivated in their catalytic function. If one half of either a TALEN or a ZFN pair contains an inactive FokI domain, then only single-strand DNA cleavage (nicking) will occur at the target site, rather than a DSB. The outcome is comparable to the use of CRISPR/Cas9/Cpf1 "nickase" mutants in which one of the Cas9 cleavage domains has been deactivated. DNA nicks can be used to drive genome editing by HDR, but at lower efficiency than with a DSB. The main benefit is that off-target nicks are quickly and accurately repaired, unlike the DSB, which is prone to NHEJ-mediated mis-repair.

A variety of TALEN-based systems have been described in the art, and modifications thereof are regularly reported; see, e.g., Boch, *Science* 326(5959):1509-12 (2009); Mak et al., *Science* 335(6069):716-9 (2012); and Moscou et al., *Science* 326(5959):1501 (2009). The use of TALENs based on the "Golden Gate" platform, or cloning scheme, has been described by multiple groups; see, e.g., Cermak et al., *Nucleic Acids Res.* 39(12):e82 (2011); Li et al., *Nucleic Acids Res.* 39(14):6315-25(2011); Weber et al., *PLoS One.* 6(2):e16765 (2011); Wang et al., *J Genet Genomics* 41(6): 339-47, Epub 2014 May 17 (2014); and Cermak T et al., *Methods Mol Biol.* 1239:133-59 (2015).

Homing Endonucleases

Homing endonucleases (HEs) are sequence-specific endonucleases that have long recognition sequences (14-44 base pairs) and cleave DNA with high specificity—often at sites unique in the genome. There are at least six known families of HEs as classified by their structure, including LAGLIDADG (SEQ ID NO: 4), GIY-YIG (SEQ ID NO: 5), His-Cis box, H—N—H, PD-(D/E)xK (SEQ ID NO: 6), and Vsr-like that are derived from a broad range of hosts, including eukarya, protists, bacteria, archaea, cyanobacteria and phage. As with ZFNs and TALENs, HEs can be used to create a DSB at a target locus as the initial step in genome editing. In addition, some natural and engineered HEs cut only a single strand of DNA, thereby functioning as site-specific nickases. The large target sequence of HEs and the specificity that they offer have made them attractive candidates to create site-specific DSBs.

A variety of HE-based systems have been described in the art, and modifications thereof are regularly reported; see, e.g., the reviews by Steentoft et al., *Glycobiology* 24(8):663-80 (2014); Belfort and Bonocora, *Methods Mol Biol.* 1123: 1-26 (2014); Hafez and Hausner, *Genome* 55(8):553-69 (2012); and references cited therein.

MegaTAL/Tev-mTALEN/MegaTev

As further examples of hybrid nucleases, the MegaTAL platform and Tev-mTALEN platform use a fusion of TALE DNA binding domains and catalytically active HEs, taking advantage of both the tunable DNA binding and specificity of the TALE, as well as the cleavage sequence specificity of the HE; see, e.g., Boissel et al., *NAR* 42: 2591-2601 (2014); Kleinstiver et al., G3 4:1155-65 (2014); and Boissel and Scharenberg, *Methods Mol. Biol.* 1239: 171-96 (2015).

In a further variation, the MegaTev architecture is the fusion of a meganuclease (Mega) with the nuclease domain derived from the GIY-YIG homing endonuclease I-TevI (Tev). The two active sites are positioned ~30 bp apart on a DNA substrate and generate two DSBs with non-compatible cohesive ends; see, e.g., Wolfs et al., *NAR* 42, 8816-29 (2014). It is anticipated that other combinations of existing nuclease-based approaches will evolve and be useful in achieving the targeted genome modifications described herein.

dCas9-FokI or dCpf1-FokI and Other Nucleases

Combining the structural and functional properties of the nuclease platforms described above offers a further approach to genome editing that can potentially overcome some of the inherent deficiencies. As an example, the CRISPR genome editing system typically uses a single Cas9 endonuclease to create a DSB. The specificity of targeting is driven by a 20 or 22 nucleotide sequence in the guide RNA that undergoes Watson-Crick base-pairing with the target DNA (plus an additional 2 bases in the adjacent NAG or NGG PAM sequence in the case of Cas9 from *S. pyogenes*). Such a sequence is long enough to be unique in the human genome, however, the specificity of the RNA/DNA interaction is not absolute, with significant promiscuity sometimes tolerated, particularly in the 5' half of the target sequence, effectively reducing the number of bases that drive specificity. One solution to this has been to completely deactivate the Cas9 or Cpf1 catalytic function—retaining only the RNA-guided DNA binding function—and instead fusing a FokI domain to the deactivated Cas9; see, e.g., Tsai et al., *Nature Biotech* 32: 569-76 (2014); and Guilinger et al., *Nature Biotech*. 32: 577-82 (2014). Because FokI must dimerize to become catalytically active, two guide RNAs are required to tether two FokI fusions in close proximity to form the dimer and cleave DNA. This essentially doubles the number of bases in the combined target sites, thereby increasing the stringency of targeting by CRISPR-based systems.

As further example, fusion of the TALE DNA binding domain to a catalytically active HE, such as I-TevI, takes advantage of both the tunable DNA binding and specificity of the TALE, as well as the cleavage sequence specificity of I-TevI, with the expectation that off-target cleavage may be further reduced.

Additional Aspects

Provided herein are nucleic acids, vectors, cells, methods, and other materials for use in ex vivo and in vivo methods for creating permanent changes to the genome by deleting, inserting, or modulating the expression of or function of one or more nucleic acids or exons within or near a target gene or other DNA sequences that encode regulatory elements of the target gene or knocking in a cDNA, expression vector, or minigene, which may be used to treat a medical condition such as, by way of non-limiting example, cancer, inflammatory disease and/or autoimmune disease. Also provided herein are components, kits, and compositions for performing such methods. Also provided are cells produced by such methods.

The following paragraphs are also encompassed by the present disclosure:

1. An isolated nucleic acid encoding a knock-in chimeric antigen receptor (CAR) construct, wherein the knock-in CAR construct comprises a polynucleotide donor template comprising at least a portion of a target gene operably linked to a nucleic acid encoding a chimeric antigen receptor (CAR) comprising: (i) an ectodomain comprising an antigen recognition region; (ii) a transmembrane domain, and (iii) an endodomain comprising at least one costimulatory domain.

2. The isolated nucleic acid of paragraph 1, further comprising a promoter, one or more gene regulatory elements, or a combination thereof.

3. The isolated nucleic acid of paragraph 2, wherein the one or more gene regulatory elements are selected from the group consisting of an enhancer sequence, an intron sequence, a polyadenylation (poly(A)) sequence, and combinations thereof.

4. The isolated nucleic acid of any one of paragraphs 1 to 3, wherein the target gene comprises a gene sequence associated with host versus graft response, a gene sequence associated with graft versus host response, a gene sequence encoding a checkpoint inhibitor, or any combination thereof.

5. The isolated nucleic acid of paragraph 4, wherein the gene sequence associated with a graft versus host response is selected from the group consisting of TRAC, CD3-episolon (CDR), and combinations thereof.

6. The isolated nucleic acid of paragraph 4, wherein the gene sequence associated with a host versus graft response is selected from the group consisting of B2M, CIITA, RFX5, and combinations thereof.

7. The isolated nucleic acid of paragraph 4, wherein the gene sequence encoding a checkpoint inhibitor is selected from the group consisting of PD1, CTLA-4, and combinations thereof.

8. The isolated nucleic acid of any one of paragraphs 1 to 3, wherein the target gene comprises a sequence associated with pharmacological modulation of a cell.

9. The isolated nucleic acid of paragraph 8, wherein the target gene is CD52.

10. The isolated nucleic acid of paragraph 8, wherein the modulation is positive or negative.

11. The isolated nucleic acid of paragraph 8, wherein the modulation allows the CAR T cells to survive.

12. The isolated nucleic acid of paragraph 8, wherein the modulation kills the CAR T cells.

13. The isolated nucleic acid of paragraph 1, further comprising a minigene or cDNA.

14. The isolated nucleic acid of paragraph 13, wherein the minigene or cDNA comprises a gene sequence associated with pharmacological modulation of a cell.

15. The isolated nucleic acid of paragraph 14, wherein the gene sequence encodes Her2.

16. The isolated nucleic acid of paragraph 4, wherein the target gene comprises a gene selected from the group consisting of TRAC, CD3ε, B2M, CIITA, RFX5, PD1, CTLA-4, CD52, PPP1R12C, and combinations thereof.

17. The isolated nucleic acid of paragraph 4, wherein the target gene comprises a gene selected from the group consisting of TRAC, B2M and PD1.

18. The isolated nucleic acid of paragraph 4, wherein the target gene comprises two or more genes selected from the group consisting of TRAC, CD3ε, B2M, CIITA, RFX5, PD1, CTLA-4, CD52, PPP1R12C, and combinations thereof.

19. The isolated nucleic acid of paragraph 4, wherein the target gene comprises two or more genes selected from the group consisting of TRAC, B2M and PD1.

20. The isolated nucleic acid of any one of paragraphs 1 to 19, wherein the donor template is either a single or double stranded polynucleotide.

21. The isolated nucleic acid of paragraph 20, wherein the portion of the target gene is selected from the group consisting of TRAC, CD3ε, B2M, CIITA, RFX5, PD1, CTLA-4, CD52, PPP1R12C, and combinations thereof.

22. The isolated nucleic acid of paragraph 20, wherein the portion of the target gene comprises a portion of TRAC, a portion of B2M, and/or a portion of PD1.

23. The isolated nucleic acid of any one of paragraphs 1 to 22, wherein the antigen recognition domain recognizes CD19, BCMA, CD70, or combinations thereof.

24. The isolated nucleic acid of any one of paragraphs 1 to 22, wherein the antigen recognition domain recognizes CD19.

25. The isolated nucleic acid of any one of paragraphs 1 to 22, wherein the antigen recognition domain recognizes CD70.

26. The isolated nucleic acid of any one of paragraphs 1 to 22, wherein the antigen recognition domain recognizes BCMA.

27. The isolated nucleic acid of any one of paragraphs 1 to 26, wherein the antigen recognition domain is a scFV.

28. The isolated nucleic acid of paragraph 27, wherein the scFV is an anti-CD19 scFv encoded by a nucleic acid sequence comprising SEQ ID NO: 1333 or an amino acid sequence comprising SEQ ID NO: 1334.

29. The isolated nucleic acid of paragraph 27, wherein the scFV is an anti-CD70 scFv
   1) encoded by a nucleic acid sequence comprising SEQ ID NO: 1475 or an amino acid sequence comprising SEQ ID NO: 1499 or
   2) encoded by a nucleic acid sequence comprising SEQ ID NO: 1476 or an amino acid sequence comprising SEQ ID NO: 1500.

30. The isolated nucleic acid of paragraph 27, wherein the scFV is an anti-BCMA scFv
   1) encoded by a nucleic acid sequence comprising SEQ ID NO: 1477-1498 or an amino acid sequence comprising SEQ ID NO: 1501-1522 or
   2) encoded by a nucleic acid sequence comprising SEQ ID NO: 1485 or an amino acid sequence comprising SEQ ID NO: 1509.

31. The isolated nucleic acid of any one of paragraphs 1 to 30, wherein the costimulatory domain comprises a CD28 co-stimulatory domain or a 4-1BB co-stimulatory domain.

32. The isolated nucleic acid of any one of paragraphs 1 to 31, wherein the endodomain further comprises a CD3-zeta (CD3ζ) domain.

33. The isolated nucleic acid of any one of paragraphs 1 to 32, wherein the ectodomain further comprises a signal peptide.

34. The isolated nucleic acid of any one of paragraphs 1 to 33, wherein the ectodomain further comprises a hinge between the antigen recognition region and the transmembrane domain.

35. The isolated nucleic acid of paragraph 34, wherein the hinge comprises a CD8 hinge region.

36. The isolated nucleic acid of any one of paragraphs 1 to 35, wherein the antigen recognition domain is a single chain variable fragment (scFv), wherein the hinge region comprises a CD8 hinge region, and wherein the endodomain comprises a CD28 costimulatory domain and a CD3ζ domain, or a 4-1BB co-stimulatory domain and a CD3ζ domain.

38. The isolated nucleic acid of any one of paragraphs 1 to 36, wherein the CAR construct has the following structural arrangement from N-terminus to C-terminus: antigen recognition domain scFv+CD8 hinge+transmembrane domain+CD28 costimulatory domain+CD3ζ domain, or antigen recognition domain scFv+CD8 hinge+transmembrane domain+4-1BB costimulatory domain+CD3ζ domain.

39. The isolated nucleic acid of any of paragraphs 1 to 38, wherein the donor template sequence comprises a sequence selected from the group consisting of SEQ ID NOs: 1387-1422.

40. The isolated nucleic acid of any of paragraphs 1 to 38, wherein the donor template sequence comprises the sequence of SEQ ID NO: 1390.

41. The isolated nucleic acid of any of paragraphs 1 to 38, wherein the donor template sequence comprises a sequence selected from the group consisting of SEQ ID NOs: 1394-1396.

42. The isolated nucleic acid of any of paragraphs 1 to 38, wherein the donor template sequence comprises a sequence selected from the group consisting of SEQ ID NOs: 1397-1422, for example, SEQ ID NOs: 1398, 1401, 1402, 1408, or 1409.

43. A vector comprising the isolated nucleic acid of any one of paragraphs 1 to 42.

44. The vector of paragraph 42, wherein the vector is an AAV.

45. The vector of paragraph 43 or 44, wherein the AAV vector is an AAV6 vector.

46. The vector of paragraph 43 or 44, wherein the vector comprises a DNA sequence selected from the group consisting of SEQ ID NO: 1348-1386.

47. The vector of paragraph 43 or 44, wherein the vector comprises a DNA sequence of SEQ ID NO: 1354.

48. The vector of paragraph 42 or 43, wherein the vector comprises a DNA sequence selected from the group consisting of SEQ ID NO: 1358-1360.

49. The vector of paragraph 42 or 43, wherein the vector comprises a DNA sequence selected from the group consisting of SEQ ID NO: 1362, 1365, 1366, 1372, and 1373.

50. An isolated cell comprising the vector of any of paragraphs 43-49.

51. The isolated cell of paragraph 50, wherein the cell is a T cell.

52. The isolated cell of paragraph 51, wherein the T-cell is a $CD4^+$ T-cell, a $CD8^+$ T-cell, or a combination thereof.

53. One or more guide ribonucleic acids (gRNAs) for editing a gene, the one or more gRNAs selected from the group consisting of:
   (a) one or more gRNAs for editing a TRAC gene, the one or more gRNAs comprising a spacer sequence selected from the group consisting of the nucleic acid sequences of SEQ ID NOs: 83-158;
   (b) one or more gRNAs for editing a B2M gene, the one or more gRNAs comprising a spacer sequence selected from the group consisting of the nucleic acid sequences of SEQ ID NOs: 458-506;
   (c) one or more gRNAs for editing a CIITA gene, the one or more gRNAs comprising a spacer sequence selected from the group consisting of the nucleic acid sequences of SEQ ID NOs: 699-890;
   (d) one or more gRNAs for editing a CD3ε gene, the one or more gRNAs comprising a spacer sequence selected from the group consisting of the nucleic acid sequences of SEQ ID NOs: 284-408; or
   (e) one or more gRNAs for editing a PD1 gene, the one or more gRNAs comprising a spacer sequence selected from the group consisting of the nucleic acid sequences of SEQ ID NOs: 1083-1274.

54. The one or more gRNAs of paragraph 53, wherein the one or more gRNAs are one or more single-molecule guide RNAs (sgRNAs).

55. The one or more gRNAs or sgRNAs of paragraph 53 or 54, wherein the one or more gRNAs or one or more sgRNAs is one or more modified gRNAs or one or more modified sgRNAs.

56. A ribonucleoprotein particle comprising the one or more gRNAs or sgRNAs of any one of paragraphs 53-55 and one or more site-directed polypeptides.

57. The ribonucleoprotein particle of paragraph 56, wherein the one or more site-directed polypeptides is one or more deoxyribonucleic acid (DNA) endonucleases.

58. The ribonucleoprotein particle of paragraph 57, wherein the one or more DNA endonucleases is a Cas9 or Cpf1 endonuclease; or a homolog thereof, recombination of the naturally occurring molecule, codon-optimized, or modified version thereof, and combinations thereof.

59. The ribonucleoprotein particle of paragraph 57 or 58, wherein the one or more DNA endonucleases is pre-complexed with one or more gRNAs or one or more sgRNAs.

60. A composition comprising the isolated nucleic acid of any one of paragraphs 1-42 and one or more ribonucleoprotein particles of any one of paragraphs 56-59.

61. The composition of paragraph 60, wherein the target gene is a TRAC gene, the antigen recognition region recognizes CD19, and the donor template comprises at least a portion of a TRAC gene.

62. The composition of paragraph 60, wherein the target gene is a B2M gene, the antigen recognition region recognizes CD19, and the donor template comprises at least a portion of a B2M gene.

63. The composition of paragraph 60, wherein the target gene is a PD1 gene, the antigen recognition region recognizes CD19, and the donor template comprises at least a portion of a PD1 gene.

64. The composition of paragraph 60, wherein the target gene is a TRAC gene, the antigen recognition region recognizes CD70, and the donor template comprises at least a portion of a TRAC gene.

65. The composition of paragraph 60, wherein the target gene is a B2M gene, the antigen recognition region recognizes CD70, and the donor template comprises at least a portion of a B2M gene.

66. The composition of paragraph 60, wherein the target gene is a PD1 gene, the antigen recognition region recognizes CD70, and the donor template comprises at least a portion of a PD1 gene.

67. The composition of paragraph 60, wherein the target gene is a TRAC gene, the antigen recognition region recognizes BCMA, and the donor template comprises at least a portion of a TRAC gene.

68. The composition of paragraph 60, wherein the target gene is a B2M gene, the antigen recognition region recognizes BCMA, and the donor template comprises at least a portion of a B2M gene.

69. The composition of paragraph 60, wherein the target gene is a PD1 gene, the antigen recognition region recognizes BCMA, and the donor template comprises at least a portion of a PD1 gene.

70. The composition of any one of paragraphs 61-69, wherein the donor template is either a single or double stranded polynucleotide.

71. The composition of any one of paragraphs 60, 61, 64, 67 or 70, wherein the one or more ribonucleoprotein particles comprises one or more DNA endonucleases and one or more gRNAs for editing a TRAC gene, the one or more gRNAs comprising a spacer sequence selected from the group consisting of the nucleic acid sequences of SEQ ID NOs: 83-158.

72. The composition of any one of paragraphs 60, 62, 65, 68 or 70, wherein the one or more ribonucleoprotein particles comprises one or more DNA endonucleases and one or more gRNAs for editing a B2M gene, the one or more gRNAs comprising a spacer sequence selected from the group consisting of the nucleic acid sequences of SEQ ID NOs: 458-506.

73. The composition of any one of paragraphs 60, 63, 66, 69 or 70, wherein the one or more ribonucleoprotein particles comprises one or more DNA endonucleases and one or more gRNAs for editing a PD1 gene, the one or more gRNAs comprising a spacer sequence selected from the group consisting of the nucleic acid sequences of SEQ ID NOs: 1083-1274.

74. The composition of paragraph 71 or 73, wherein the one or more ribonucleoprotein particles further comprises one or more gRNAs for editing a B2M gene, the one or more gRNAs comprising a spacer sequence selected from the group consisting of the nucleic acid sequences of SEQ ID NOs: 458-506.

75. The composition of paragraph 71 or 72, wherein the one or more ribonucleoprotein particles further comprises one or more gRNAs for editing a PD1 gene, the one or more gRNAs comprising a spacer sequence selected from the group consisting of the nucleic acid sequences of SEQ ID NOs: 1083-1274.

76. The composition of paragraph 72 or 73, wherein the one or more ribonucleoprotein particles further comprises one or more gRNAs for editing a TRAC gene, the one or more gRNAs comprising a spacer sequence selected from the group consisting of the nucleic acid sequences of SEQ ID NOs: 83-158.

77. A composition comprising the vector of any one of paragraphs 43-49, and one or more ribonucleoprotein particles of any one of paragraphs 56-59.

78. The composition of paragraph 77, wherein the target gene is a TRAC gene, the antigen recognition region recognizes CD19, and the donor template comprises at least a portion of a TRAC gene.

79. The composition of paragraph 77, wherein the target gene is a B2M gene, the antigen recognition region recognizes CD19, and the donor template comprises at least a portion of a B2M gene.

80. The composition of paragraph 77, wherein the target gene is a PD1 gene, the antigen recognition region recognizes CD19, and the donor template comprises at least a portion of a PD1 gene.

81. The composition of paragraph 77, wherein the target gene is a TRAC gene, the antigen recognition region recognizes CD70, and the donor template comprises at least a portion of a TRAC gene.

82. The composition of paragraph 77, wherein the target gene is a B2M gene, the antigen recognition region recognizes CD70, and the donor template comprises at least a portion of a B2M gene.

83. The composition of paragraph 77, wherein the target gene is a PD1 gene, the antigen recognition region recognizes CD70, and the donor template comprises at least a portion of a PD1 gene.

84. The composition of paragraph 77, wherein the target gene is a TRAC gene, the antigen recognition region recognizes BCMA, and the donor template comprises at least a portion of a TRAC gene.

85. The composition of paragraph 77, wherein the target gene is a B2M gene, the antigen recognition region recognizes BCMA, and the donor template comprises at least a portion of a B2M gene.

86. The composition of paragraph 77, wherein the target gene is a PD1 gene, the antigen recognition region recognizes BCMA, and the donor template comprises at least a portion of a PD1 gene.

87. The composition of paragraph any one of paragraphs 78-86, wherein the donor template is either a single or double stranded polynucleotide.

88. The composition of any one of paragraphs 77, 78, 81, 84 or 87, wherein the one or more ribonucleoprotein particles comprises one or more DNA endonucleases and one or more gRNAs for editing a TRAC gene, the one or more gRNAs comprising a spacer sequence selected from the group consisting of the nucleic acid sequences of SEQ ID NOs: 83-158.

89. The composition of any one of paragraphs 77, 79, 82, 85 or 87, wherein the one or more ribonucleoprotein particles comprises one or more DNA endonucleases and one or more gRNAs for editing a B2M gene, the one or more gRNAs comprising a spacer sequence selected from the group consisting of the nucleic acid sequences of SEQ ID NOs: 458-506.

90. The composition of any one of paragraphs 77, 80, 83, 86 or 87, wherein the one or more ribonucleoprotein particles comprises one or more DNA endonucleases and one or more gRNAs for editing a PD1 gene, the one or more gRNAs comprising a spacer sequence selected from the group consisting of the nucleic acid sequences of SEQ ID NOs: 1083-1275.

91. The composition of paragraph 88 or 90, wherein the one or more ribonucleoprotein particles further comprises one or more gRNAs for editing a B2M gene, the one or more gRNAs comprising a spacer sequence selected from the group consisting of the nucleic acid sequences of SEQ ID NOs: 458-506.

92. The composition of paragraph 88 or 89, wherein the one or more ribonucleoprotein particles further comprises one or more gRNAs for editing a PD1 gene, the one or more gRNAs comprising a spacer sequence selected from the group consisting of the nucleic acid sequences of SEQ ID NOs: 1083-1275.

93. The composition of paragraph 89 or 90, wherein the one or more ribonucleoprotein particles further comprises one or more gRNAs for editing a TRAC gene, the one or more gRNAs comprising a spacer sequence selected from the group consisting of the nucleic acid sequences of SEQ ID NOs: 83-158.

94. The composition of any one of paragraphs 77, 78, 81, 84, 87, 88 or 93, wherein the donor template comprises a sequence selected from the group consisting of SEQ ID NOs: 1387 and 1390 and the gRNA is an sgRNA for editing a TRAC gene comprising the sequence of SEQ ID NO: 1342 or 1343.

95. The composition of any one of paragraphs 77, 78, 81, 84, 87, 88 or 93, wherein the donor template comprises a sequence selected from the group consisting of SEQ ID NOs: 1394-1396 and the gRNA is an sgRNA for editing a TRAC gene comprising the sequence of SEQ ID NO: 1342 or 1343.

96. The composition of any one of paragraphs 77, 78, 81, 84, 87, 88 or 93, wherein the donor template comprises a sequence selected from the group consisting of SEQ ID NOs: 1398, 1400, 1401, 1402, 1408, and 1409 and the gRNA is an sgRNA for editing a TRAC gene comprising the sequence of SEQ ID NO: 1342 or 1343.

97. The composition of any one of paragraphs 94-96, further comprising an sgRNA for editing a B2M gene comprising the sequence of SEQ ID NO: 1344 or 1345.

98. The composition of any one of paragraphs 77, 79, 82, 85, 87, 89, 91, wherein the donor template comprises a sequence selected from the group consisting of SEQ ID NOs: 1387 and 1390 and the gRNA is an sgRNA for editing a B2M gene comprising the sequence of SEQ ID NO: 1342 or 1343.

99. The composition of any one of paragraphs 77, 79, 82, 85, 87, 89, 91, wherein the donor template comprises a sequence selected from the group consisting of SEQ ID NOs: 1394 and 1395 and the gRNA is an sgRNA for editing a B2M gene comprising the sequence of SEQ ID NO: 1342 or 1343.

100. The composition of any one of paragraphs 77, 79, 82, 85, 87, 89, 91, wherein the donor template comprises a sequence selected from the group consisting of SEQ ID NOs: 1398 and 1400 and the gRNA is an sgRNA for editing a B2M gene comprising the sequence of SEQ ID NO: 1342 or 1343.

101. An isolated cell comprising the isolated nucleic acid of any one of paragraphs 1-42, and one or more ribonucleoprotein particles of any one of paragraphs 56-59.

102. The isolated cell of paragraph 101, wherein the target gene is a TRAC gene, the antigen recognition region recognizes CD19, and the donor template comprises at least a portion of a TRAC gene.

103. The isolated cell of paragraph 101, wherein the target gene is a B2M gene, the antigen recognition region recognizes CD19, and the donor template comprises at least a portion of a B2M gene.

104. The isolated cell of paragraph 101, wherein the target gene is a PD1 gene, the antigen recognition region recognizes CD19, and the donor template comprises at least a portion of a PD1 gene.

105. The isolated cell of paragraph 101, wherein the target gene is a TRAC gene, the antigen recognition region recognizes CD70, and the donor template comprises at least a portion of a TRAC gene.

106. The isolated cell of paragraph 101, wherein the target gene is a B2M gene, the antigen recognition region recognizes CD70, and the donor template comprises at least a portion of a B2M gene.

107. The isolated cell of paragraph 101, wherein the target gene is a PD1 gene, the antigen recognition region recognizes CD70, and the donor template comprises at least a portion of a PD1 gene.

108. The isolated cell of paragraph 101, wherein the target gene is a TRAC gene, the antigen recognition region recognizes BCMA, and the donor template comprises at least a portion of a TRAC gene.

109. The isolated cell of paragraph 101, wherein the target gene is a B2M gene, the antigen recognition region recognizes BCMA, and the donor template comprises at least a portion of a B2M gene.

110. The isolated cell of paragraph 101, wherein the target gene is a PD1 gene, the antigen recognition region recognizes BCMA, and the donor template comprises at least a portion of a PD1 gene.

111. The isolated cell of any one of paragraphs 102-110, wherein the donor template is either a single or double stranded polynucleotide.

112. The isolated cell of any one of paragraphs 101, 102, 105, 108 or 111, wherein the one or more ribonucleoprotein particles comprises one or more DNA endonucleases and one or more gRNAs for editing a TRAC gene, the one or more gRNAs comprising a spacer sequence selected from the group consisting of the nucleic acid sequences of SEQ ID NOs: 83-158.

113. The isolated cell of any one of paragraphs 101, 103, 106, 109 or 111, wherein the one or more ribonucleoprotein particles comprises one or more DNA endonucleases and one or more gRNAs for editing a B2M gene, the one or more gRNAs comprising a spacer sequence selected from the group consisting of the nucleic acid sequences of SEQ ID NOs: 458-506.

114. The isolated cell of any one of paragraphs 101, 104, 107, 110 or 111, wherein the one or more ribonucleoprotein particles comprises one or more DNA endonucleases and one or more gRNAs for editing a PD1 gene, the one or more gRNAs comprising a spacer sequence selected from the group consisting of the nucleic acid sequences of SEQ ID NOs: 1083-1274.

115. The isolated cell of paragraph 112 or 114, wherein the one or more ribonucleoprotein particles further comprises one or more gRNAs for editing a B2M gene, the one or more gRNAs comprising a spacer sequence selected from the group consisting of the nucleic acid sequences of SEQ ID NOs: 458-506.

116. The isolated cell of paragraph 112 or 113, wherein the one or more ribonucleoprotein particles further comprises one or more gRNAs for editing a PD1 gene, the one or more gRNAs comprising a spacer sequence selected from the group consisting of the nucleic acid sequences of SEQ ID NOs: 1083-1274.

117. The isolated cell of paragraph 113 or 114, wherein the one or more ribonucleoprotein particles further comprises one or more gRNAs for editing a TRAC gene, the one or more gRNAs comprising a spacer sequence selected from the group consisting of the nucleic acid sequences of SEQ ID NOs: 83-158.

118. The isolated cell of any one of paragraphs 101-118, wherein the one or more ribonucleoprotein particles comprises two or more different populations of ribonucleoprotein particles.

119. The isolated cell of paragraph 118, wherein the wherein the one or more ribonucleoprotein particles comprises one or more DNA endonucleases and two or more different populations of ribonucleoprotein particles selected from the group consisting of:

(a) one or more gRNAs for editing a TRAC gene, the one or more gRNAs comprising a spacer sequence selected from the group consisting of the nucleic acid sequences of SEQ ID NOs: 83-158;

(b) one or more gRNAs for editing a B2M gene, the one or more gRNAs comprising a spacer sequence selected from the group consisting of the nucleic acid sequences of SEQ ID NOs: 458-506;

(c) one or more gRNAs for editing a CIITA gene, the one or more gRNAs comprising a spacer sequence selected from the group consisting of the nucleic acid sequences of SEQ ID NOs: 699-890 for editing the CIITA gene;

(d) one or more gRNAs for editing a CD3ε gene, the one or more gRNAs comprising a spacer sequence selected from the group consisting of the nucleic acid sequences of SEQ ID NOs: 284-408;

(e) one or more gRNAs for editing a PD1 gene, the one or more gRNAs comprising a spacer sequence selected from the group consisting of the nucleic acid sequences of SEQ ID NOs: 1083-1274;

(f) one or more gRNAs for editing a TRAC gene, the one or more gRNAs comprising a spacer sequence comprising the nucleic acid sequence of SEQ ID NO: 1299;

(g) one or more gRNAs for editing a CTLA-4 gene, the one or more gRNAs comprising a spacer sequence comprising the nucleic acid sequence of SEQ ID NO: 1277;

(h) one or more gRNAs for editing a AAVS1 (PPP1R12C) gene the one or more gRNAs comprising a spacer sequence selected from the group consisting of the nucleic acid sequences of SEQ ID NOs: 1301-1302;

(i) one or more gRNAs for editing a CD52 gene, the one or more gRNAs comprising a spacer sequence selected from the group consisting of the nucleic acid sequences of SEQ ID NOs: 1303-1304; and (j) one or more gRNAs for editing a RFX5 gene, the one or more gRNAs comprising a spacer sequence selected from the group consisting of the nucleic acid sequences of SEQ ID NOs: 1305-1307.

120. An isolated cell comprising the isolated nucleic acid of and one of paragraph 1-42 and a first population of one or more ribonucleoprotein particles of any one of paragraphs 56-59, wherein the isolated nucleic acid is inserted into the genome at a locus within or near a first target gene that results is a permanent deletion within or near the first target gene and insertion of the isolated nucleic acid encoding the CAR.

121. The isolated cell of paragraph 120, wherein the isolated cell further comprises a second population of one or more ribonucleoprotein particles of any one of paragraphs 56-59, wherein the first population of one or more ribonucleoprotein particles comprises one or more gRNAs for editing a first target gene and the second population of one or more ribonucleoprotein particles comprises one or more gRNAs for editing a second, different target gene.

122. An isolated cell, expressing a chimeric antigen receptor encoded by the nucleic acid of any one of paragraphs 1-42 and comprising a deletion in one or more genes selected from: TRAC, CD3ε, B2M, CIITA, RFX5, PD1, and CTLA-4.

123. An isolated cell, expressing a chimeric antigen receptor encoded by the nucleic acid of any one of paragraphs 1-42 and comprising a deletion in one or more of TRAC, B2M and PD1.

124. An isolated cell, expressing a chimeric antigen receptor encoded by the nucleic acid of any one of paragraphs 1-42 and comprising a deletion in TRAC.

125. The isolated cell of paragraph 124, further comprising a deletion in B2M.

126. The isolated cell of paragraph 124, further comprising a deletion in B2M and PD1.

127. The isolated cell of any one of paragraphs 101-126, wherein the chimeric antigen receptor is expressed from the TRAC locus.

128. The isolated cell of paragraph 127, wherein the chimeric antigen receptor comprises a sequence selected from the group consisting of SEQ ID NO: 1334, 1499, 1500, 1501, and 1502.

129. The isolated cell of paragraph 127, wherein the chimeric antigen receptor (CAR) comprises a sequence encoding the CAR selected from the group consisting of SEQ ID NO: 1316, 1423, 1424, 1425 and 1426.

130. The isolated cell of paragraph 127, wherein the chimeric antigen receptor (CAR) comprises an amino acid sequence selected from the group consisting of SEQ ID NO: 1338, 1449, 1450, 1451 and 1452.

131. An isolated cell transfected with the vector comprising a nucleic acid selected from the group consisting of: SEQ ID Nos: 1348, 1354, 1358, 1359, 1362 and 1364 and further comprising a deletion in one or more genes selected from: TRAC, CD3ε, B2M, CIITA, RFX5, PD1, and CTLA-4.

132. An isolated cell transfected with the vector comprising a nucleic acid selected from the group consisting of: SEQ ID Nos: 1348, 1354, 1358, 1359, 1362 and 1364 and further comprising a deletion in TRAC.

133. An isolated cell transfected with the vector comprising a nucleic acid selected from the group consisting of: SEQ ID Nos: 1348, 1354, 1358, 1359, 1362 and 1364 and further comprising a deletion in TRAC and B2M.

134. An isolated cell transfected with the vector comprising a nucleic acid selected from the group consisting of: SEQ ID Nos: 1348, 1354, 1358, 1359, 1362 and 1364 and further comprising a deletion in TRAC, B2M and PD1.

135. The isolated cell of any one of paragraphs 127-134, wherein the nucleic acid sequence comprises a donor template that is permanently inserted in the TRAC gene, disrupting TRAC gene expression.

136. The isolated cell of paragraph 135, further comprising a deletion in the B2M gene.

137. The isolated cell of paragraph 136, further comprising a deletion in the PD1 gene.

138. The isolated cell of any one of paragraphs 131-137, wherein:
   a) one or more ribonucleoprotein particles effect one or more single-strand breaks or double-strand breaks in the TRAC target gene resulting a permanent deletion in the TRAC gene, wherein the ribonucleoprotein particles comprise one or more sgRNAs comprising a sequence SEQ ID NO: 1342 or 1343 and one or more deoxyribonucleic acid (DNA) endonucleases; and
   b) one or more ribonucleoprotein particles effect one or more single-strand breaks or double-strand breaks in the B2M target gene resulting a permanent deletion in the B2M gene, wherein the ribonucleoprotein particles comprise one or more sgRNAs comprising a sequence of SEQ ID NO: 1344 or 1345 and one or more deoxyribonucleic acid (DNA) endonucleases 139. An isolated cell comprising:
   a) the isolated nucleic acid of any one of paragraph 1-42, wherein the isolated nucleic acid is inserted into the genome by homologous recombination at a locus within or near a TRAC gene that results is a permanent deletion within or near the TRAC gene;
   b) a permanent deletion within or near a second target gene, wherein the second target gene is B2M;
   c) insertion of the isolated nucleic acid encoding the CAR into the TRAC gene, wherein the CAR comprises a CD19 antigen recognition domain; and
   d) the CAR is expressed on the surface of the cell.

140. An isolated cell comprising:
   a) the isolated nucleic acid of any one of paragraphs 1-42, wherein the isolated nucleic acid is inserted into the genome by homologous recombination at a locus within or near a TRAC gene that results is a permanent deletion within or near the TRAC gene;
   b) a permanent deletion within or near a second target gene, wherein the second target gene is B2M;
   c) insertion of the isolated nucleic acid encoding the CAR into the TRAC gene, wherein the CAR comprises a CD70 antigen recognition domain; and
   d) the CAR is expressed on the surface of the cell.

141. An isolated cell comprising:
   a) the isolated nucleic acid of any one of paragraphs 1-42, wherein the isolated nucleic acid is inserted into the genome by homologous recombination at a locus within or near a TRAC gene that results is a permanent deletion within or near the TRAC gene;
   b) a permanent deletion within or near a second target gene, wherein the second target gene is B2M;
   c) insertion of the isolated nucleic acid encoding the CAR into the TRAC gene, wherein the CAR comprises a BCMA antigen recognition domain; and
   d) the CAR is expressed on the surface of the cell.

142. The isolated cell of any one of paragraphs 139-141, further comprising a permanent deletion within or near a third target gene, wherein the third target gene is PD1.

143. The isolated cell of any one of paragraphs 139-142, wherein:
   a) the isolated nucleic acid comprises a nucleotide sequence of SEQ ID Nos: 1348, 1354, 1358, 1359, 1362 and 1364;
   b) one or more gRNAs comprise a spacer sequence selected from SEQ ID Nos: 83-158 and one or more deoxyribonucleic acid (DNA) endonucleases, effect one or more single-strand breaks or double-strand breaks in the TRAC gene resulting a permanent deletion in the TRAC gene; and
   c) one or more gRNAs comprising a spacer sequence selected from SEQ ID Nos: 458-506 and one or more deoxyribonucleic acid (DNA) endonucleases, effect one or more single-strand breaks or double-strand breaks in the B2M gene resulting a permanent deletion in the B2M gene.

144. The isolated cell of paragraph 143, wherein:
   a) the isolated nucleic acid comprises a nucleotide sequence is selected from the group consisting of SEQ ID NO: 1348-1357;
   b) one or more ribonucleoprotein particles effect one or more single-strand breaks or double-strand breaks in the TRAC target gene resulting a permanent deletion in the TRAC target gene, wherein the ribonucleoprotein particles comprise one or more sgRNAs comprising a sequence SEQ ID NO: 1342 or 1343 and one or more deoxyribonucleic acid (DNA) endonucleases; and
   c) one or more ribonucleoprotein particles effect one or more single-strand breaks or double-strand breaks in the B2M target gene resulting a permanent deletion in the B2M target gene, wherein the ribonucleoprotein particles comprise one or more sgRNAs comprising a sequence of SEQ ID NO: 1344 or 1345 and one or more deoxyribonucleic acid (DNA) endonucleases.

145. The isolated cell of paragraph 143, wherein:
   a) the isolated nucleic acid comprises a nucleotide sequence is selected from the group consisting of SEQ ID NO: 1358 and 1359;
   b) one or more ribonucleoprotein particles effect one or more single-strand breaks or double-strand breaks in the TRAC target gene resulting a permanent deletion in the TRAC target gene, wherein the ribonucleoprotein particles comprise one or more sgRNAs comprising a sequence SEQ ID NO: 1342 or 1343 and one or more deoxyribonucleic acid (DNA) endonucleases; and
   c) one or more ribonucleoprotein particles effect one or more single-strand breaks or double-strand breaks in the B2M target gene resulting a permanent deletion in the B2M target gene, wherein the ribonucleoprotein particles comprise one or more sgRNAs comprising a sequence of SEQ ID NO: 1344 or 1345 and one or more deoxyribonucleic acid (DNA) endonucleases.

146. The isolated cell of paragraph 143, wherein:
   a) the isolated nucleic acid comprises a nucleotide sequence is selected from the group consisting of SEQ ID NO: 1362 and 1364;
   b) one or more ribonucleoprotein particles effect one or more single-strand breaks or double-strand breaks in the TRAC target gene resulting a permanent deletion in the TRAC target gene, wherein the ribonucleoprotein particles comprise one or more sgRNAs comprising a sequence SEQ ID NO: 1342 or 1343 and one or more deoxyribonucleic acid (DNA) endonucleases; and
   c) one or more ribonucleoprotein particles effect one or more single-strand breaks or double-strand breaks in the B2M target gene resulting a permanent deletion in the B2M target gene, wherein the ribonucleoprotein particles comprise one or more sgRNAs comprising a sequence of SEQ ID NO: 1344 or 1345 and one or more deoxyribonucleic acid (DNA) endonucleases.

147. A pharmaceutical composition comprising the isolated cell of any one of paragraphs 101-146.

148. A method for producing a gene edited cell, the method comprising the steps of: introducing into the cell (i) the isolated nucleic acid encoding a knock-in chimeric antigen receptor (CAR) construct of any one of paragraphs 1-42, (ii) one or more sgRNA and (iii) one or more deoxyribonucleic acid (DNA) endonucleases to effect one or more single-strand breaks (SSBs) or double-strand breaks (DSBs) within or near a first target gene that results in: a) a permanent deletion within or near the first target gene affecting the expression or function of the first target gene, optionally wherein the permanent deletion is in the PAM or sgRNA target sequence, and optionally wherein the permanent deletion is a 20 nucleotide deletion, b) insertion of the CAR construct within or near the first target gene, and, c) expression of the CAR on the surface of a cell.

149. A method for modulating one or more biological activities of a cell, the method comprising the step of: introducing into the cell (i) the isolated nucleic acid encoding a knock-in chimeric antigen receptor (CAR) construct of any one of paragraphs 1-42, (ii) one or more sgRNA and (iii) one or more deoxyribonucleic acid (DNA) endonucleases to effect one or more single-strand breaks (SSBs) or double-strand breaks (DSBs) within or near a first target gene that results in: a) a permanent deletion within or near the first target gene affecting the expression or function of the first target gene, optionally wherein the permanent deletion is in the PAM or sgRNA target sequence, and optionally wherein the permanent deletion is a 20 nucleotide deletion, b) insertion of the CAR construct within or near the first target gene, and, c) expression of the CAR on the surface of a cell.

150. The method of paragraph 148 or 149, wherein the gRNA and endonuclease form a ribonucleoprotein particle.

151. The method of any one of paragraphs 148-150, further comprising the step of introducing into the cell one or more gRNA and one or more deoxyribonucleic acid (DNA) endonucleases to effect one or more single-strand breaks (SSBs) or double-strand breaks (DSBs) within or near a second target gene that results in a permanent deletion within or near the second target gene affecting the expression or function of the second target gene.

152. The method of paragraph 151, wherein the gRNA and endonuclease form a ribonucleoprotein particle.

153. The method of any one of paragraphs 148-152, wherein the permanent deletion results in modulating one or more biological activities.

154. The method of paragraph 153, wherein modulating biological activities comprises knocking out a biological activity of the first target gene, the second target gene, optionally a third target gene, or a combination thereof.

155. The method of paragraph 153 or 154, wherein the biological activity is host versus graft response, graft versus host response, immune checkpoint response, immune suppression, or any combination thereof.

156. The method of paragraph 153 or 154, wherein the biological activity is a graft versus host response, and the first target gene, the second target gene, or a combination thereof is selected from the group consisting of TRAC, CD3-epsilon (CDR), and combinations thereof.

157. The method of paragraph 153 or 154, wherein the biological activity is a host versus graft response, and the first target gene, the second target gene, or a combination thereof is selected from the group consisting of B2M, CIITA, RFX5, and combinations thereof.

158. The method of paragraph 153 or 154, wherein the biological activity is a checkpoint inhibitor, and the first target gene, the second target gene, or a combination thereof is selected from the group consisting of PD1, CTLA-4, and combinations thereof.

159. The method of paragraph 153 or 154, wherein the biological activity is increased cell survival or enhanced cell viability, and the first target gene, the second target gene, or a combination thereof is selected from the group consisting of TRAC, B2M, PD1, and combinations thereof.

160. The method of paragraph 153 or 154, wherein the gene encodes a sequence modulating pharmacological control of CAR T.

161. The method of paragraph 160, wherein the gene encodes CD52.

162. The method of paragraph 160, wherein the modulation is positive or negative.

163. The method of paragraph 160, wherein the modulation allows the CART cells to survive.

164. The method of paragraph 160, wherein the modulation kills the CART cells.

165. The method of any one of paragraphs 153, 154, or 163, wherein the first target gene, the second target gene, or a combination thereof comprises a gene selected from the group consisting of TRAC, CD3ε, B2M, CIITA, RFX5, PD1, CTLA-4, CD52, PPP1R12C, and combinations thereof.

166. The method of any one of paragraphs 153, 154, or 163, wherein the first target gene, the second target gene, or a combination thereof comprises two or more genes selected from the group consisting of TRAC, B2M, PD1 and combinations thereof.

167. The method of any one of paragraphs 153, 154, or 163, wherein the first target gene, the second target gene, or a combination thereof comprises TRAC, B2M and PD1.

168. The method of paragraph 153 or 154, wherein the donor template is either a single or double stranded polynucleotide.

169. The method of paragraph 168, wherein the portion of the target gene is selected from the group consisting of TRAC, CD3ε, B2M, CIITA, RFX5, PD1, CTLA-4, CD52, PPP1R12C, and combinations thereof.

170. The method of paragraph 169, wherein the portion of the target gene is selected from the group consisting of TRAC, B2M, PD1 and combinations thereof.

171. The method of paragraph 169, wherein the portion of the target gene comprises a portion of TRAC.

172. The method of paragraph 169, wherein the portion of the target gene comprises a portion of TRAC and/or a portion of B2M.

173. The method of paragraph 169, wherein the portion of the target gene comprises a portion of TRAC, a portion of B2M, and/or a portion of PD1.

174. The method of paragraph 153 or 154, wherein the one or more DNA endonucleases is pre-complexed with one or more gRNAs, optionally one or more sgRNAs.

175. The method of paragraph 153 or 154, wherein the donor template is delivered by a viral vector.

176. The method of paragraph 175, wherein the viral vector is an adeno-associated virus (AAV) vector.

177. The method of paragraph 176, wherein the AAV vector is an AAV6 vector.

178. The method of paragraph 153 or 154, wherein the cell is a primary human T cell.

179. The method of paragraph 178, wherein the primary human T cell is isolated from peripheral blood mononuclear cells (PBMCs).

180. The method of paragraph 178 or 179, wherein the cells are allogeneic.

181. The method of any one of paragraphs 148-180, wherein the one or more DNA endonucleases is a Cas9, or Cpf1 endonuclease; or a homolog thereof, recombination of the naturally occurring molecule, codon-optimized, or modified version thereof, and combinations thereof.

182. The method of paragraph 181, wherein the method comprises introducing into the cell one or more polynucleotides encoding the one or more DNA endonucleases.

183. The method of paragraph 182, wherein the method comprises introducing into the cell one or more ribonucleic acids (RNAs) encoding the one or more DNA endonucleases.

184. The method of paragraph 181 or 182, wherein the one or more polynucleotides or one or more RNAs is one or more modified polynucleotides or one or more modified RNAs.

185. The method of paragraph 184, wherein the DNA endonuclease is a protein or polypeptide.

186. An ex vivo method for treating a patient with a medical condition comprising the steps of:
   i) isolating a T cell from the patient;
   ii) editing within or near a target gene of the T cell or other DNA sequences that encode regulatory elements of the target gene of the T cell; and
   iii) implanting the genome-edited T cell into the patient.

187. An ex vivo method for treating a patient with a medical condition comprising the steps of:
   i) isolating a T cell from a donor;
   ii) editing within or near a target gene of the T cell or other DNA sequences that encode regulatory elements of the target gene of the T cell; and
   iii) implanting the genome-edited T cell into the patient.

188. The method of paragraph 186 or 187, wherein the isolating step comprises: cell differential centrifugation, cell culturing, and combinations thereof.

189. A method for treating a patient with a medical condition comprising the steps of:
   i) editing within or near one or more target genes of the T cell, or one or more other DNA sequences that encode regulatory elements of the target gene of the T cell; and
   ii) implanting the genome-edited T cell into the patient.

190. The method of any one of paragraphs 186-189, wherein the editing step comprises introducing into the T cell (i) the isolated nucleic acid encoding a knock-in chimeric antigen receptor (CAR) construct of any one of paragraphs 1-42, (ii) one or more gRNA and (iii) one or more deoxyribonucleic acid (DNA) endonucleases to effect one or more single-strand breaks (SSBs) or double-strand breaks (DSBs) within or near a first target gene that results in: a) a permanent deletion within or near the first target gene affecting the expression or function of the first target gene, optionally wherein the permanent deletion is in the PAM or sgRNA target sequence, and optionally wherein the permanent deletion is a 20 nucleotide deletion, b) insertion of the CAR construct within or near the first target gene, and, c) expression of the CAR on the surface of a cell.

191. The method of paragraph 190, further comprising the step of introducing into the cell one or more gRNA and one or more deoxyribonucleic acid (DNA) endonucleases to effect one or more single-strand breaks (SSBs) or double-strand breaks (DSBs) within or near a second target gene that results in a permanent deletion within or near the second target gene affecting the expression or function of the second target gene.

192. The method of any one of paragraphs 189-191, wherein the implanting step comprises implanting the genome-edited T cell into the patient by transplantation, local injection, or systemic infusion, or combinations thereof.

193. The method of any one of paragraphs 189-192, wherein the T-cell is a CD4$^+$ T-cell, a CD8$^+$ T-cell, or a combination thereof.

194. The method of any one of paragraphs 189-193, wherein the medical condition is cancer.

195. The method of paragraph 194, wherein the cancer is B-cell acute lymphoblastic leukemia (B-ALL), B-cell non-Hodgkin's lymphoma (B-NHL), Chronic lymphocytic leukemia (C-CLL), Hodgkin's lymphoma, T cell lymphoma, T cell leukemia, clear cell renal cell carcinoma (ccRCC), thyroid cancer, nasopharyngeal cancer, non-small cell lung (NSCLC), pancreatic cancer, melanoma, ovarian cancer, glioblastoma, cervical cancer, or multiple myeloma.

196. An in vivo method for treating a patient with a medical condition comprising the step of editing a first target gene in a cell of the patient, or other DNA sequences that encode regulatory elements of the target gene, wherein the editing step comprises introducing into the T cell (i) the isolated nucleic acid encoding a knock-in chimeric antigen receptor (CAR) construct of any one of paragraphs 1-42, (ii) one or more gRNA and (iii) one or more deoxyribonucleic acid (DNA) endonucleases to effect one or more single-strand breaks (SSBs) or double-strand breaks (DSBs) within or near a first target gene that results in: a) a permanent deletion within or near the first target gene affecting the expression or function of the first target gene, optionally wherein the permanent deletion is in the PAM or sgRNA target sequence, and optionally wherein the permanent deletion is a 20 nucleotide deletion, b) insertion of the CAR construct within or near the first target gene, and, c) expression of the CAR on the surface of the cell.

197. The method of paragraph 196, further comprising the step of introducing into the cell one or more gRNA and one or more deoxyribonucleic acid (DNA) endonucleases to effect one or more single-strand breaks (SSBs) or double-strand breaks (DSBs) within or near a second target gene that results in a permanent deletion within or near the second target gene affecting the expression or function of the second target gene.

198. The method of paragraph 196 or 197, wherein the T-cell is a CD4$^+$ T-cell, a CD8$^+$ T-cell, or a combination thereof.

199. The method of any one of paragraphs 196-198, wherein the medical condition is cancer.

200. The method of paragraph 180, wherein the cancer is B-cell acute lymphoblastic leukemia (B-ALL), B-cell non-Hodgkin's lymphoma (B-NHL), Chronic lymphocytic leukemia (C-CLL), Hodgkin's lymphoma, T cell lymphoma, T cell leukemia, clear cell renal cell carcinoma (ccRCC), thyroid cancer, nasopharyngeal cancer, non-small cell lung (NSCLC), pancreatic cancer, melanoma, ovarian cancer, glioblastoma, cervical cancer, or multiple myeloma.

201. An isolated nucleic acid comprising a nucleic acid sequence selected from the group consisting of SEQ ID NOs: 1348-1357.

202. An isolated nucleic acid comprising a nucleic acid sequence selected from the group consisting of SEQ ID NOs: 1358-1359.

203. An isolated nucleic acid comprising a nucleic acid sequence selected from the group consisting of SEQ ID NOs: 1361-1364.

204. A method for treating cancer in a subject comprising the steps of administering to a subject a composition comprising the isolated cell of any one of paragraphs 101-146.

205. A method for decreasing tumor volume in a subject comprising the step of administering to a subject a composition comprising the isolated cell of any one of paragraphs 101-146.

206. A method for increasing survival in a subject with cancer comprising the step of administering to a subject a composition comprising the isolated cell of any one of paragraphs 101-146.

207. The composition of any one of paragraphs 60-100, wherein the isolated nucleic acid comprises a nucleic acid sequence selected from the group consisting of SEQ ID NOs: 1348-1357, 1358-1359, 1362 and 1364.

208. The composition of any one of paragraphs 60-100 or 207, wherein the donor template comprises a sequence selected from the group consisting of SEQ ID Nos: 1390, 1394-1395, 1398 and 1400 and the gRNA is an sgRNA for editing a TRAC gene having the sequence of SEQ ID NO: 1342.

209. The composition of any one of paragraphs 60-100, 207, or 208, wherein the donor template comprises a sequence selected from the group consisting of SEQ ID Nos: 1390, 1394-1395, 1398 and 1400, the gRNA is an sgRNA for editing a TRAC gene having the sequence of SEQ ID NO: 1342 and the sgRNA for editing a B2M gene having the sequence of SEQ ID NO: 1344.

The term "comprising" or "comprises" is used in reference to compositions, methods, and respective component(s) thereof, that are essential to the invention, yet open to the inclusion of unspecified elements, whether essential or not.

The term "consisting essentially of" refers to those elements required for a given aspect. The term permits the presence of additional elements that do not materially affect the basic and novel or functional characteristic(s) of that aspect of the invention.

The term "consisting of" refers to compositions, methods, and respective components thereof as described herein, which are exclusive of any element not recited in that description of the aspect.

The singular forms "a," "an," and "the" include plural references, unless the context clearly dictates otherwise.

Certain numerical values presented herein are preceded by the term "about." The term "about" is used to provide literal support for the numerical value the term "about" precedes, as well as a numerical value that is approximately the numerical value, that is the approximating unrecited numerical value may be a number which, in the context it is presented, is the substantial equivalent of the specifically recited numerical value. The term "about" means numerical values within ±10% of the recited numerical value.

When a range of numerical values is presented herein, it is contemplated that each intervening value between the lower and upper limit of the range, the values that are the upper and lower limits of the range, and all stated values with the range are encompassed within the disclosure. All the possible sub-ranges within the lower and upper limits of the range are also contemplated by the disclosure.

EXAMPLES

The invention will be more fully understood by reference to the following embodiments, which provide illustrative non-limiting aspects of the invention.

The examples describe the use of the CRISPR system as an illustrative genome editing technique to create defined therapeutic genomic deletions, insertions, or replacements, termed "genomic modifications" herein, in or near a target gene that lead to permanent correction of mutations in the genomic locus, or expression at a heterologous locus, that restore target protein activity. Introduction of the defined therapeutic modifications represents a novel therapeutic strategy for the potential amelioration of various medical conditions, as described and illustrated herein.

Example 1—Screening of gRNAs

To identify a large spectrum of gRNAs able to edit the cognate DNA target region, an in vitro transcribed (IVT) gRNA screen was conducted. Spacer sequences were incorporated into a backbone sequence to generate full length sgRNAs. Examples of backbone sequences are shown in Table 1. To generate a list of spacer sequences to be used for gene disruption, protein coding exons were selected for each target gene, particularly those containing the initiating ATG start codon and/or coding for critical protein domains (e.g., DNA binding domains, extracellular domains, etc.). The relevant genomic sequence was submitted for analysis using gRNA design software. The resulting list of gRNAs was narrowed to a list of about ~200 gRNAs based on uniqueness of sequence (only gRNAs without a perfect match somewhere else in the genome were screened) and minimal predicted off target effects. This set of gRNAs was in vitro transcribed, and transfected using messenger Max into HEK293T cells that constitutively express Cas9. Cells were harvested 48 hours post transfection, the genomic DNA was isolated, and editing efficiency was evaluated using Tracking of Indels by DEcomposition (TIDE) analysis. The results are shown in FIGS. 1-5 and Tables below.

It is conventional in the art to describe a gRNA spacer sequence in the context of a DNA target (e.g., genomic) sequence, which is adject to the PAM sequence. It is understood, however, that the actual gRNA spacer sequence used in the methods and compositions herein is the equivalent of the DNA target sequence. For example, the TRAC gRNA spacer sequence described as including AGAGCAACAGTGCTGTGGCC (SEQ ID NO: 76), actual includes the RNA spacer sequence AGAGCAACAGUGCUGUGGCC (SEQ ID NO: 152).

TRAC gRNA Screen

For TRAC, genomic segments containing the first three (3) protein coding exons were used as input in the gRNA design software. The genomic segments also included flanking splice site acceptor/donor sequences. Desired gRNAs were those that would lead to insertions or deletions in the coding sequence disrupting the amino acid sequence of TRAC leading to out of frame/loss of function allele(s). All 76 in silico-identified gRNA spacers targeting TRAC were used in an IVT screen. Seventy three (73) yielded measurable data by TIDE analysis. Nine (9) gRNA sequences yielded InDel percentages above 50% that could be suitable for secondary screens.

A homology-dependent assessment of the TRAC gRNA comprising SEQ ID NO: 152 showed that this guide had an indel frequency of less than 0.5% at an off-target site. This data guided selection of this particular TRAC gRNA for further analysis.

TABLE 4

TRAC target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| GTAAAACCAA GAGGCCACAG | 7 | GUAAAACCAA GAGGCCACAG | 83 | TRAC EXON3_T23 | 97.7 | 0.99 |

TABLE 4-continued

TRAC target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| GACTGTGCCTCTGTTTGACT | 8 | GACUGUGCCUCUGUUUGACU | 84 | TRAC EXON3_T15 | 88.4 | 0.946 |
| GTTATGGGCTTGCATGTCCC | 9 | GUUAUGGGCUUGCAUGUCCC | 85 | TRAC EXON3_T7 | 63.5 | 0.967 |
| TCTCTCAGCTGGTACACGGC | 10 | UCUCUCAGCUGGUACACGGC | 86 | TRAC EXON1_T1 | 59.1 | 0.949 |
| CACCAAAGCTGCCCTTACCT | 11 | CACCAAAGCUGCCCUUACCU | 87 | TRAC EXON1_T15 | 59 | 0.96 |
| GAGAATCAAAATCGGTGAAT | 12 | GAGAAUCAAAAUCGGUGAAU | 88 | TRAC EXON1_T7 | 56.5 | 0.976 |
| ATCCTCCTCCTGAAAGTGGC | 13 | AUCCUCCUCCUGAAAGUGGC | 89 | TRAC EXON3_T16 | 55.5 | 0.96 |
| AGCAAGGAAACAGCCTGCGA | 14 | AGCAAGGAAACAGCCUGCGA | 90 | TRAC EXON1_T9 | 54.2 | 0.897 |
| TGTGCTAGACATGAGGTCTA | 15 | UGUGCUAGACAUGAGGUCUA | 91 | TRAC EXON1_T3 | 53.8 | 0.973 |
| CCGAATCCTCCTCCTGAAAG | 16 | CCGAAUCCUCCUCCUGAAAG | 92 | TRAC EXON3_T13 | 52.1 | 0.947 |
| CCACTTTCAGGAGGAGGATT | 17 | CCACUUUCAGGAGGAGGAUU | 93 | TRAC EXON3_T19 | 46.9 | 0.955 |
| CATCACAGGAACTTTCTAAA | 18 | CAUCACAGGAACUUUCUAAA | 94 | TRAC EXON2_T8 | 43.7 | 0.98 |
| CGTCATGAGCAGATTAAACC | 19 | CGUCAUGAGCAGAUUAAACC | 95 | TRAC EXON3_T6 | 43.5 | 0.98 |
| TAGGCAGACAGACTTGTCAC | 20 | UAGGCAGACAGACUUGUCAC | 96 | TRAC EXON1_T6 | 41.5 | 0.983 |
| ACCCGGCCACTTTCAGGAGG | 21 | ACCCGGCCACUUUCAGGAGG | 97 | TRAC EXON3_T11 | 40.7 | 0.975 |
| GCACCAAAGCTGCCCTTACC | 22 | GCACCAAAGCUGCCCUUACC | 98 | TRAC EXON1_T5 | 37.6 | 0.984 |
| ACCTGGCCATTCCTGAAGCA | 23 | ACCUGGCCAUUCCUGAAGCA | 99 | TRAC EXON1_T21 | 37.6 | 0.79 |
| TACCAAACCCAGTCAAACAG | 24 | UACCAAACCCAGUCAAACAG | 100 | TRAC EXON3_T12 | 37.4 | 0.939 |
| GACACCTTCTTCCCCAGCCC | 25 | GACACCUUCUUCCCCAGCCC | 101 | TRAC EXON1_T40 | 37.1 | 0.984 |
| TCTGTTTGACTGGGTTTGGT | 26 | UCUGUUUGACUGGGUUUGGU | 102 | TRAC EXON3_T14 | 36.6 | 0.926 |
| TCCTCCTCCTGAAAGTGGCC | 27 | UCCUCCUCCUGAAAGUGGCC | 103 | TRAC EXON3_T18 | 32.8 | 0.98 |
| AGACTGTGCCTCTGTTTGAC | 28 | AGACUGUGCCUCUGUUUGAC | 104 | TRAC EXON3_T8 | 31.4 | 0.94 |
| ATGCAAGCCCATAACCGCTG | 29 | AUGCAAGCCCAUAACCGCUG | 105 | TRAC EXON3_T1 | 30.7 | 0.986 |
| GCTTTGAAACAGGTAAGACA | 30 | GCUUUGAAACAGGUAAGACA | 106 | TRAC EXON2_T7 | 29.4 | 0.979 |
| CAAGAGGCCACAGCGGTTAT | 31 | CAAGAGGCCACAGCGGUUAU | 107 | TRAC EXON3_T4 | 28.3 | 0.987 |
| CCATAACCGCTGTGGCCTCT | 32 | CCAUAACCGCUGUGGCCUCU | 108 | TRAC EXON3_T9 | 27.5 | 0.982 |

TABLE 4-continued

TRAC target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| ACAAAACTGT GCTAGACATG | 33 | ACAAAACUGU GCUAGACAUG | 109 | TRAC EXON1_T16 | 27.4 | 0.988 |
| TTCGGAACCC AATCACTGAC | 34 | UUCGGAACCC AAUCACUGAC | 110 | TRAC EXON3_T5 | 26.9 | 0.984 |
| GATTAAACCC GGCCACTTTC | 35 | GAUUAAACCC GGCCACUUUC | 111 | TRAC EXON3_T2 | 26.6 | 0.984 |
| TCTGTGGGAC AAGAGGATCA | 36 | UCUGUGGGAC AAGAGGAUCA | 112 | TRAC EXON1_T20 | 24.4 | 0.989 |
| GCTGGTACAC GGCAGGGTCA | 37 | GCUGGUACAC GGCAGGGUCA | 113 | TRAC EXON1_T22 | 24.1 | 0.991 |
| CTCTCAGCTG GTACACGGCA | 38 | CUCUCAGCUG GUACACGGCA | 114 | TRAC EXON1_T13 | 23.7 | 0.99 |
| CTGACAGGTT TTGAAAGTTT | 39 | CUGACAGGUU UUGAAAGUUU | 115 | TRAC EXON3_T25 | 23.3 | 0.982 |
| AGAGTCTCTC AGCTGGTACA | 40 | AGAGUCUCUC AGCUGGUACA | 116 | TRAC EXON1_T25 | 18.9 | 0.992 |
| CTCGACCAGC TTGACATCAC | 41 | CUCGACCAGC UUGACAUCAC | 117 | TRAC EXON2_T1 | 16.5 | 0.992 |
| TAAACCCGGC CACTTTCAGG | 42 | UAAACCCGGC CACUUUCAGG | 118 | TRAC EXON3_T10 | 12.9 | 0.991 |
| GTCAGGGTTC TGGATATCTG | 43 | GUCAGGGUUC UGGAUAUCUG | 119 | TRAC EXON1_T27 | 12.8 | 0.992 |
| TTCGTATCTGT AAAACCAAG | 44 | UUCGUAUCUG UAAAACCAAG | 120 | TRAC EXON3_T24 | 12.8 | 0.994 |
| CTTCAAGAGC AACAGTGCTG | 45 | CUUCAAGAGC AACAGUGCUG | 121 | TRAC EXON1_T17 | 12.5 | 0.99 |
| CTGGATATCT GTGGGACAAG | 46 | CUGGAUAUCU GUGGGACAAG | 122 | TRAC EXON1_T31 | 12.1 | 0.992 |
| AAGTTCCTGT GATGTCAAGC | 47 | AAGUUCCUGU GAUGUCAAGC | 123 | TRAC EXON2_T3 | 11.6 | 0.991 |
| GGCAGCTTTG GTGCCTTCGC | 48 | GGCAGCUUUG GUGCCUUCGC | 124 | TRAC EXON1_T2 | 11 | 0.99 |
| CTTCTTCCCCA GCCCAGGTA | 49 | CUUCUUCCCC AGCCCAGGUA | 125 | TRAC EXON1_T33 | 10.6 | 0.993 |
| TTCAAAACCT GTCAGTGATT | 50 | UUCAAAACCU GUCAGUGAUU | 126 | TRAC EXON3_T21 | 9.4 | 0.966 |
| TCAGGGTTCT GGATATCTGT | 51 | UCAGGGUUCU GGAUAUCUGU | 127 | TRAC EXON1_T18 | 9.3 | 0.973 |
| GTCGAGAAAA GCTTTGAAAC | 52 | GUCGAGAAAA GCUUUGAAAC | 128 | TRAC EXON2_T4 | 8.9 | 0.991 |
| TTAATCTGCTC ATGACGCTG | 53 | UUAAUCUGCU CAUGACGCUG | 129 | TRAC EXON3_T26 | 8.7 | 0.993 |
| CTGTTTCCTTG CTTCAGGAA | 54 | CUGUUUCCUU GCUUCAGGAA | 130 | TRAC EXON1_T39 | 7.6 | 0.99 |
| TGGATTTAGA GTCTCTCAGC | 55 | UGGAUUUAGA GUCUCUCAGC | 131 | TRAC EXON1_T4 | 7.3 | 0.993 |
| CTTACCTGGG CTGGGGAAGA | 56 | CUUACCUGGG CUGGGGAAGA | 132 | TRAC EXON1_T38 | 6.7 | 0.993 |

TABLE 4-continued

TRAC target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| AGCCCAGGTAAGGGCAGCTT | 57 | AGCCCAGGUAAGGGCAGCUU | 133 | TRAC EXON1_T11 | 6.1 | 0.994 |
| GGGACAAGAGGATCAGGGTT | 58 | GGGACAAGAGGAUCAGGGUU | 134 | TRAC EXON1_T26 | 5 | 0.993 |
| TTCTTCCCCAGCCCAGGTAA | 59 | UUCUUCCCCAGCCCAGGUAA | 135 | TRAC EXON1_T35 | 4.9 | 0.994 |
| TGCCTCTGTTTGACTGGGTT | 60 | UGCCUCUGUUUGACUGGGUU | 136 | TRAC EXON3_T17 | 4.9 | 0.94 |
| AGCTGGTACACGGCAGGGTC | 61 | AGCUGGUACACGGCAGGGUC | 137 | TRAC EXON1_T8 | 4.3 | 0.994 |
| TGCTCATGACGCTGCGGCTG | 62 | UGCUCAUGACGCUGCGGCUG | 138 | TRAC EXON3_T27 | 3.4 | 0.994 |
| TTTCAAAACCTGTCAGTGAT | 63 | UUUCAAAACCUGUCAGUGAU | 139 | TRAC EXON3_T20 | 2.1 | 0.965 |
| ACACGGCAGGGTCAGGGTTC | 64 | ACACGGCAGGGUCAGGGUUC | 140 | TRAC EXON1_T14 | 1.4 | 0.994 |
| AGCTTTGAAACAGGTAAGAC | 65 | AGCUUUGAAACAGGUAAGAC | 141 | TRAC EXON2_T5 | 1.4 | 0.993 |
| CTGGGGAAGAAGGTGTCTTC | 66 | CUGGGGAAGAAGGUGUCUUC | 142 | TRAC EXON1_T28 | 1.3 | 0.994 |
| TCCTTGCTTCAGGAATGGCC | 67 | UCCUUGCUUCAGGAAUGGCC | 143 | TRAC EXON1_T29 | 1.2 | 0.98 |
| AAGCTGCCCTTACCTGGGCT | 68 | AAGCUGCCCUUACCUGGGCU | 144 | TRAC EXON1_T24 | 1.1 | 0.995 |
| AACAAATGTGTCACAAAGTA | 69 | AACAAAUGUGUCACAAAGUA | 145 | TRAC EXON1_T36 | 1.1 | 0.995 |
| AAAGTCAGATTTGTTGCTCC | 70 | AAAGUCAGAUUUGUUGCUCC | 146 | TRAC EXON1_T12 | 0.8 | 0.995 |
| AGCTGCCCTTACCTGGGCTG | 71 | AGCUGCCCUUACCUGGGCUG | 147 | TRAC EXON1_T30 | 0.8 | 0.995 |
| TGGAATAATGCTGTTGTTGA | 72 | UGGAAUAAUGCUGUUGUUGA | 148 | TRAC EXON1_T34 | 0.8 | 0.994 |
| ATTTGTTTGAGAATCAAAAT | 73 | AUUUGUUUGAGAAUCAAAAU | 149 | TRAC EXON1_T37 | 0.7 | 0.996 |
| AAAGCTGCCCTTACCTGGGC | 74 | AAAGCUGCCCUUACCUGGGC | 150 | TRAC EXON1_T10 | 0.5 | 0.995 |
| CCAAGAGGCCACAGCGGTTA | 75 | CCAAGAGGCCACAGCGGUUA | 151 | TRAC EXON3_T3 | 0.5 | 0.994 |
| AGAGCAACAGTGCTGTGGCC | 76 | AGAGCAACAGUGCUGUGGCC | 152 | TRAC EXON1_T32 | 0.2 | 0.994 |
| ATCTGTGGGACAAGAGGATC | 77 | AUCUGUGGGACAAGAGGAUC | 153 | TRAC EXON1_T19 | 0.1 | 0.994 |
| GGTAAGACAGGGGTCTAGCC | 78 | GGUAAGACAGGGGUCUAGCC | 154 | TRAC EXON2_T2 | 0.1 | 0.993 |
| GTAAGACAGGGGTCTAGCCT | 79 | GUAAGACAGGGGUCUAGCCU | 155 | TRAC EXON2_T6 | 0.1 | 0.994 |
| GCAGGCTGTTTCCTTGCTTC | 80 | GCAGGCUGUUUCCUUGCUUC | 156 | TRAC EXON1_T23 | | |

TABLE 4-continued

TRAC target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| CTTTGAAACAGGTAAGACAG | 81 | CUUUGAAACAGGUAAGACAG | 157 | TRAC EXON2_T9 | | |
| AGAGGCACAGTCTCTTCAGC | 82 | AGAGGCACAGUCUCUUCAGC | 158 | TRAC EXON3_T22 | | |

In some embodiments, a gRNA comprises the sequence of any one of SEQ ID NOs: 83-158 or targets the sequence of any one of SEQ ID NOs: 7-82.

CD3*ε gRNA Screen

For CD3ε (CD3E), genomic segments containing the five (5) protein coding exons were used as input in the gRNA design software. The genomic segments also included flanking splice site acceptor/donor sequences. Desired gRNAs were those that would lead to insertions or deletions in the coding sequence disrupting the amino acid sequence of CD3E leading to out of frame/loss of function allele(s). One hundred twenty five (125) in silico identified gRNA spacers targeting CD3E were used in an IVT screen. One hundred twenty (120) yielded measurable data by TIDE analysis. Nine (9) gRNA sequences yielded InDel percentages above 50% that could be suitable for secondary screens.

TABLE 5

CD3E target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| GTCAGAGGAGATTCCTGCCA | 159 | GUCAGAGGAGAUUCCUGCCA | 284 | CD3E exon4_T18 | 83.2 | 0.976 |
| AGAGGAGATTCCTGCCAAGG | 160 | AGAGGAGAUUCCUGCCAAGG | 285 | CD3E exon4_T20 | 61.6 | 0.955 |
| GAACTTTTATCTCTACCTGA | 161 | GAACUUUUAUCUCUACCUGA | 286 | CD3E exon3_T22 | 58.8 | 0.984 |
| AAGCCTGTGACACGAGGAGC | 162 | AAGCCUGUGACACGAGGAGC | 287 | CD3E exon4_T11 | 57.8 | 0.919 |
| CATCCTACTCACCTGATAAG | 163 | CAUCCUACUCACCUGAUAAG | 288 | CD3E exon1_T14 | 54.9 | 0.978 |
| CTGGATTACCTCTTGCCCTC | 164 | CUGGAUUACCUCUUGCCCUC | 289 | CD3E exon3_T12 | 54.4 | 0.98 |
| CATGAAACAAAGATGCAGTC | 165 | CAUGAAACAAAGAUGCAGUC | 290 | CD3E exon1_T18 | 53.1 | 0.97 |
| ATTTCAGATCCAGGATACTG | 166 | AUUUCAGAUCCAGGAUACUG | 291 | CD3E exon3_T13 | 51.5 | 0.964 |
| TCAGAGGAGATTCCTGCCAA | 167 | UCAGAGGAGAUUCCUGCCAA | 292 | CD3E exon4_T12 | 51.3 | 0.96 |
| GCAGTTCTCACACACTGTGG | 168 | GCAGUUCUCACACACUGUGG | 293 | CD3E exon4_T29 | 49.6 | 0.975 |
| CACAATGATAAAAACATAGG | 169 | CACAAUGAUAAAAACAUAGG | 294 | CD3E exon3_T28 | 49.1 | 0.95 |
| GTGTGAGAACTGCATGGAGA | 170 | GUGUGAGAACUGCAUGGAGA | 295 | CD3E exon4_T37 | 48.8 | 0.84 |
| GATGTCCACTATGACAATTG | 171 | GAUGUCCACUAUGACAAUUG | 296 | CD3E exon4_T4 | 48 | 0.93 |
| ACTCACCTGATAAGAGGCAG | 172 | ACUCACCUGAUAAGAGGCAG | 297 | CD3E exon1_T13 | 45.5 | 0.959 |
| CTCTTATCAGGTGAGTAGGA | 173 | CUCUUAUCAGGUGAGUAGGA | 298 | CD3E exon1_T7 | 44.1 | 0.974 |

TABLE 5-continued

CD3E target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| TATCTCTACCTGAGGGCAAG | 174 | UAUCUCUACCUGAGGGCAAG | 299 | CD3E exon3_T10 | 43.6 | 0.764 |
| ATCCTGGATCTGAAATACTA | 175 | AUCCUGGAUCUGAAAUACUA | 300 | CD3E exon3_T20 | 43.5 | 0.951 |
| AGATGGAGACTTTATATGCT | 176 | AGAUGGAGACUUUAUAUGCU | 301 | CD3E exon3_T14 | 42.4 | 0.955 |
| CTGCCTCTTATCAGGTGAGT | 177 | CUGCCUCUUAUCAGGUGAGU | 302 | CD3E exon1_T5 | 40.1 | 0.967 |
| TATATGCTGGGAGAAAGAA | 178 | UAUAUGCUGGGGAGAAAGAA | 303 | CD3E exon3_T29 | 40 | 0.972 |
| AGTGGACATCTGCATCACTG | 179 | AGUGGACAUCUGCAUCACUG | 304 | CD3E exon4_T24 | 38.8 | 0.969 |
| CAAGCCTGTGACACGAGGAG | 180 | CAAGCCUGUGACACGAGGAG | 305 | CD3E exon4_T10 | 38 | 0.974 |
| GTGGACATCTGCATCACTGG | 181 | GUGGACAUCUGCAUCACUGG | 306 | CD3E exon4_T13 | 36.9 | 0.947 |
| GATGGAGACTTTATATGCTG | 182 | GAUGGAGACUUUAUAUGCUG | 307 | CD3E exon3_T5 | 36.1 | 0.973 |
| TCTCACACACTGTGGGGGGT | 183 | UCUCACACACUGUGGGGGGU | 308 | CD3E exon4_T21 | 35.8 | 0.924 |
| CAGGCAAAGGGGTAAGGCTG | 184 | CAGGCAAAGGGGUAAGGCUG | 309 | CD3E exon4_T38 | 35.2 | 0.817 |
| GTTACCTCATAGTCTGGGTT | 185 | GUUACCUCAUAGUCUGGGUU | 310 | CD3E exon5_T7 | 35.1 | 0.978 |
| CTTCTGGTTTGCTTCCTCTG | 186 | CUUCUGGUUUGCUUCCUCUG | 311 | CD3E exon3_T33 | 34.2 | 0.985 |
| ATGCAGTTCTCACACACTGT | 187 | AUGCAGUUCUCACACACUGU | 312 | CD3E exon4_T30 | 32.3 | 0.967 |
| CCCACGTTACCTCATAGTCT | 188 | CCCACGUUACCUCAUAGUCU | 313 | CD3E exon5_T5 | 30.4 | 0.977 |
| TTCCTCCGCAGGACAAAACA | 189 | UUCCUCCGCAGGACAAAACA | 314 | CD3E exon5_T11 | 30.2 | 0.979 |
| CTGGGCCTCTGCCTCTTATC | 190 | CUGGGCCUCUGCCUCUUAUC | 315 | CD3E exon1_T12 | 30.1 | 0.987 |
| GGAGATGGATGTGATGTCGG | 191 | GGAGAUGGAUGUGAUGUCGG | 316 | CD3E exon4_T14 | 30.1 | 0.98 |
| TGTTCCCAACCCAGACTATG | 192 | UGUUCCCAACCCAGACUAUG | 317 | CD3E exon5_T10 | 29.9 | 0.977 |
| ACACGAGGAGCGGGTGCTGG | 193 | ACACGAGGAGCGGGUGCUGG | 318 | CD3E exon4_T25 | 28.8 | 0.982 |
| TTATATGCTGGGGAGAAAGA | 194 | UUAUAUGCUGGGGAGAAAGA | 319 | CD3E exon3_T30 | 28.3 | 0.98 |
| TTTCAGATCCAGGATACTGA | 195 | UUUCAGAUCCAGGAUACUGA | 320 | CD3E exon3_T17 | 28 | 0.771 |
| CATGGAGATGGATGTGATGT | 196 | CAUGGAGAUGGAUGUGAUGU | 321 | CD3E exon4_T32 | 28 | 0.97 |
| AGATGCAGTCGGGCACTCAC | 197 | AGAUGCAGUCGGGCACUCAC | 322 | CD3E exon1_T1 | 27.5 | 0.982 |

TABLE 5-continued

CD3E target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| TATTATGTCTG CTACCCCAG | 198 | UAUUAUGUCU GCUACCCCAG | 323 | CD3E exon3_T11 | 27.5 | 0.988 |
| GTTTCCCCTCC TTCCTCCGC | 199 | GUUUCCCCUC CUUCCUCCGC | 324 | CD3E exon5_T18 | 27.1 | 0.984 |
| TAAAACATA GGCAGTGATG | 200 | UAAAACAUA GGCAGUGAUG | 325 | CD3E exon3_T25 | 26.5 | 0.895 |
| GGTGGCCACA ATTGTCATAG | 201 | GGUGGCCACA AUUGUCAUAG | 326 | CD3E exon4_T2 | 26.1 | 0.986 |
| GCATATAAAG TCTCCATCTC | 202 | GCAUAUAAAG UCUCCAUCUC | 327 | CD3E exon3_T16 | 25 | 0.98 |
| TATTACTGTGG TTCCAGAGA | 203 | UAUUACUGUG GUUCCAGAGA | 328 | CD3E exon3_T21 | 25 | 0.984 |
| CAACACAATG ATAAAAACAT | 204 | CAACACAAUG AUAAAAACAU | 329 | CD3E exon3_T26 | 24.6 | 0.963 |
| GTAATCCAGG TCTCCAGAAC | 205 | GUAAUCCAGG UCUCCAGAAC | 330 | CD3E exon3_T7 | 24.2 | 0.991 |
| CCCAGACTAT GAGGTAACGT | 206 | CCCAGACUAU GAGGUAACGU | 331 | CD3E exon5_T1 | 24.1 | 0.979 |
| ATAGTGGACA TCTGCATCAC | 207 | AUAGUGGACA UCUGCAUCAC | 332 | CD3E exon4_T8 | 24 | 0.96 |
| ATCTTCTGGTT TGCTTCCTC | 208 | AUCUUCUGGU UUGCUUCCUC | 333 | CD3E exon3_T19 | 23.9 | 0.981 |
| TTTTGTCCTGC GGAGGAAGG | 209 | UUUUGUCCUG CGGAGGAAGG | 334 | CD3E exon5_T15 | 23.7 | 0.963 |
| CTGAGGGCAA GAGGTAATCC | 210 | CUGAGGGCAA GAGGUAAUCC | 335 | CD3E exon3_T8 | 22.5 | 0.989 |
| TTGACATGCCC TCAGTATCC | 211 | UUGACAUGCC CUCAGUAUCC | 336 | CD3E exon3_T4 | 22.4 | 0.978 |
| CAGAGGAGAT TCCTGCCAAG | 212 | CAGAGGAGAU UCCUGCCAAG | 337 | CD3E exon4_T17 | 21.8 | 0.989 |
| TGCTGCTGCTG GTTTACTAC | 213 | UGCUGCUGCU GGUUUACUAC | 338 | CD3E exon4_T3 | 20.8 | 0.987 |
| GAGGTAACGT GGGATAGAAA | 214 | GAGGUAACGU GGGAUAGAAA | 339 | CD3E exon5_T20 | 20.5 | 0.965 |
| ACCCAGACTA TGAGGTAACG | 215 | ACCCAGACUA UGAGGUAACG | 340 | CD3E exon5_T2 | 20.3 | 0.977 |
| CACTGGGGGC TTGCTGCTGC | 216 | CACUGGGGGC UUGCUGCUGC | 341 | CD3E exon4_T26 | 20 | 0.987 |
| ATCAGGTGAG TAGGATGGAG | 217 | AUCAGGUGAG UAGGAUGGAG | 342 | CD3E exon1_T15 | 19.9 | 0.989 |
| GGCACTCACT GGAGAGTTCT | 218 | GGCACUCACU GGAGAGUUCU | 343 | CD3E exon1_T17 | 19 | 0.988 |
| TTTGTCCTGCG GAGGAAGGA | 219 | UUUGUCCUGC GGAGGAAGGA | 344 | CD3E exon5_T16 | 18.7 | 0.977 |
| TGAGGATCAC CTGTCACTGA | 220 | UGAGGAUCAC CUGUCACUGA | 345 | CD3E exon3_T15 | 18.2 | 0.771 |
| TTACTTTACTA AGATGGCGG | 221 | UUACUUUACU AAGAUGGCGG | 346 | CD3E exon1_T2 | 18 | 0.987 |

TABLE 5-continued

CD3E target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| TAAAAACATAGGCGGTGATG | 222 | UAAAAACAUAGGCGGUGAUG | 347 | CD3E exon3_T1 | 17 | 0.971 |
| CTGAAAATTCCTTCAGTGAC | 223 | CUGAAAAUUCCUUCAGUGAC | 348 | CD3E exon3_T18 | 16.9 | 0.779 |
| TTGTCCTGCGGAGGAAGGAG | 224 | UUGUCCUGCGGAGGAAGGAG | 349 | CD3E exon5_T21 | 16.9 | 0.99 |
| TCTTCTGGTTTGCTTCCTCT | 225 | UCUUCUGGUUUGCUUCCUCU | 350 | CD3E exon3_T31 | 16.5 | 0.98 |
| GGGCACTCACTGGAGAGTTC | 226 | GGGCACUCACUGGAGAGUUC | 351 | CD3E exon1_T8 | 15.7 | 0.989 |
| TTCTCACACACTGTGGGGGG | 227 | UUCUCACACACUGUGGGGGG | 352 | CD3E exon4_T31 | 15.4 | 0.967 |
| CGGGTGCTGGCGGCAGGCAA | 228 | CGGGUGCUGGCGGCAGGCAA | 353 | CD3E exon4_T19 | 14.8 | 0.986 |
| AGGTAACGTGGGATAGAAAT | 229 | AGGUAACGUGGGAUAGAAAU | 354 | CD3E exon5_T12 | 14.7 | 0.982 |
| CTGTTACTTTACTAAGATGG | 230 | CUGUUACUUUACUAAGAUGG | 355 | CD3E exon1_T9 | 14.6 | 0.986 |
| CCTCTCCTTGTTTTGTCCTG | 231 | CCUCUCCUUGUUUUGUCCUG | 356 | CD3E exon5_T17 | 13.7 | 0.984 |
| TAGTGGACATCTGCATCACT | 232 | UAGUGGACAUCUGCAUCACU | 357 | CD3E exon4_T15 | 13.5 | 0.978 |
| GGACTGTTACTTTACTAAGA | 233 | GGACUGUUACUUUACUAAGA | 358 | CD3E exon1_T6 | 12.2 | 0.99 |
| ACTGAAGGAATTTTCAGAAT | 234 | ACUGAAGGAAUUUUCAGAAU | 359 | CD3E exon3_T27 | 11.9 | 0.966 |
| CCATGAAACAAAGATGCAGT | 235 | CCAUGAAACAAAGAUGCAGU | 360 | CD3E exon1_T16 | 11.5 | 0.987 |
| GAGATGGAGACTTTATATGC | 236 | GAGAUGGAGACUUUAUAUGC | 361 | CD3E exon3_T2 | 11.3 | 0.986 |
| TTTTCAGAATTGGAGCAAAG | 237 | UUUUCAGAAUUGGAGCAAAG | 362 | CD3E exon3_T23 | 11 | 0.993 |
| TCATAGTCTGGGTTGGGAAC | 238 | UCAUAGUCUGGGUUGGGAAC | 363 | CD3E exon5_T14 | 10.5 | 0.984 |
| CCGCAGGACAAAACAAGGAG | 239 | CCGCAGGACAAAACAAGGAG | 364 | CD3E exon5_T13 | 10.3 | 0.985 |
| TCTGGGTTGGGAACAGGTGG | 240 | UCUGGGUUGGGAACAGGUGG | 365 | CD3E exon5_T22 | 9.5 | 0.991 |
| ACACAGACACGTGAGTTTAT | 241 | ACACAGACACGUGAGUUUAU | 366 | CD3E exon2_T1 | 9.1 | 0.926 |
| GCCAGCAGACTTACTACTTC | 242 | GCCAGCAGACUUACUACUUC | 367 | CD3E exon1_T3 | 9 | 0.987 |
| TAGTCTGGGTTGGGAACAGG | 243 | UAGUCUGGGUUGGGAACAGG | 368 | CD3E exon5_T19 | 9 | 0.99 |
| CGAACTTTTATCTCTACCTG | 244 | CGAACUUUUAUCUCUACCUG | 369 | CD3E exon3_T24 | 8.7 | 0.983 |
| CGCTCCTCGTGTCACAGGCT | 245 | CGCUCCUCGUGUCACAGGCU | 370 | CD3E exon4_T9 | 8 | 0.987 |

TABLE 5-continued

CD3E target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| CTACTGGAGC AAGAATAGAA | 246 | CUACUGGAGC AAGAAUAGAA | 371 | CD3E exon4_T28 | 8 | 0.972 |
| CGTTACCTCAT AGTCTGGGT | 247 | CGUUACCUCA UAGUCUGGGU | 372 | CD3E exon5_T4 | 7.9 | 0.984 |
| AGATAAAAGT TCGCATCTTC | 248 | AGAUAAAAGU UCGCAUCUUC | 373 | CD3E exon3_T3 | 7.8 | 0.969 |
| AAGGCCAAGC CTGTGACACG | 249 | AAGGCCAAGC CUGUGACACG | 374 | CD3E exon4_T5 | 7.8 | 0.989 |
| TGGCGGCAGG CAAAGGGGTA | 250 | UGGCGGCAGG CAAAGGGGUA | 375 | CD3E exon4_T34 | 7.7 | 0.985 |
| AGGGCATGTC AATATTACTG | 251 | AGGGCAUGUC AAUAUUACUG | 376 | CD3E exon3_T6 | 7.4 | 0.925 |
| TCGTGTCACAG GCTTGGCCT | 252 | UCGUGUCACA GGCUUGGCCU | 377 | CD3E exon4_T16 | 7.4 | 0.98 |
| TGCAGTTCTCA CACACTGTG | 253 | UGCAGUUCUC ACACACUGUG | 378 | CD3E exon4_T23 | 7.3 | 0.973 |
| GGGGGGTGGG GTGGGGAGAG | 254 | GGGGGGUGGG GUGGGGAGAG | 379 | CD3E exon4_T41 | 7 | 0.975 |
| GATGAGGATG ATAAAAACAT | 255 | GAUGAGGAUG AUAAAAACAU | 380 | CD3E exon3_T32 | 6.7 | 0.991 |
| CATGCAGTTCT CACACACTG | 256 | CAUGCAGUUC UCACACACUG | 381 | CD3E exon4_T35 | 6.4 | 0.987 |
| ACGTGGGATA GAAATGGGCC | 257 | ACGUGGGAUA GAAAUGGGCC | 382 | CD3E exon5_T9 | 6.3 | 0.987 |
| TACCACCTGA AAATGAAAAA | 258 | UACCACCUGA AAAUGAAAAA | 383 | CD3E exon2_T4 | 5.3 | 0.94 |
| TGGCAGGAAT CTCCTCTGAC | 259 | UGGCAGGAAU CUCCUCUGAC | 384 | CD3E exon4_T7 | 5 | 0.989 |
| CTCACACACTG TGGGGGGTG | 260 | CUCACACACU GUGGGGGGUG | 385 | CD3E exon4_T33 | 5 | 0.975 |
| GTGACACGAG GAGCGGGTGC | 261 | GUGACACGAG GAGCGGGUGC | 386 | CD3E exon4_T6 | 4.9 | 0.988 |
| CAGTTCTCACA CACTGTGGG | 262 | CAGUUCUCAC ACACUGUGGG | 387 | CD3E exon4_T40 | 4.9 | 0.971 |
| TGCCATAGTAT TTCAGATCC | 263 | UGCCAUAGUA UUUCAGAUCC | 388 | CD3E exon3_T9 | 4.6 | 0.984 |
| TCCAGAAGTA GTAAGTCTGC | 264 | UCCAGAAGUA GUAAGUCUGC | 389 | CD3E exon1_T4 | 4.3 | 0.989 |
| GGTGCTGGCG GCAGGCAAAG | 265 | GGUGCUGGCG GCAGGCAAAG | 390 | CD3E exon4_T36 | 4.3 | 0.971 |
| TCCCACGTTAC CTCATAGTC | 266 | UCCCACGUUA CCUCAUAGUC | 391 | CD3E exon5_T3 | 4.3 | 0.992 |
| CACAGTGTGT GAGAACTGCA | 267 | CACAGUGUGU GAGAACUGCA | 392 | CD3E exon4_T27 | 3.9 | 0.986 |
| CGACTGCATCT TTGTTTCAT | 268 | CGACUGCAUC UUUGUUUCAU | 393 | CD3E exon1_T11 | 3.8 | 0.989 |
| GGGTGCTGGC GGCAGGCAAA | 269 | GGGUGCUGGC GGCAGGCAAA | 394 | CD3E exon4_T42 | 3.8 | 0.994 |

TABLE 5-continued

CD3E target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| GAGGAGCGGG TGCTGGCGGC | 270 | GAGGAGCGGG UGCUGGCGGC | 395 | CD3E exon4_T45 | 3.3 | 0.994 |
| TTGTTTTGTCC TGCGGAGGA | 271 | UUGUUUUGUC CUGCGGAGGA | 396 | CD3E exon5_T8 | 3.2 | 0.99 |
| CTCCTTGTTTT GTCCTGCGG | 272 | CUCCUUGUUU UGUCCUGCGG | 397 | CD3E exon5_T6 | 3.1 | 0.99 |
| CCGACTGCATC TTTGTTTCA | 273 | CCGACUGCAU CUUUGUUUCA | 398 | CD3E exon1_T10 | 1.9 | 0.991 |
| TGTTTCCTTTT TTCATTTTC | 274 | UGUUUCCUUU UUUCAUUUUC | 399 | CD3E exon2_T2 | 1.9 | 0.92 |
| TTCCTTTTTTC ATTTTCAGG | 275 | UUCCUUUUUU CAUUUUCAGG | 400 | CD3E exon2_T3 | 1.5 | 0.94 |
| AGGCTGTGGA GTCCAGTCAG | 276 | AGGCUGUGGA GUCCAGUCAG | 401 | CD3E exon4_T22 | 1.2 | 0.992 |
| TGGGGGGTGG GGTGGGGAGA | 277 | UGGGGGGUGG GGUGGGGAGA | 402 | CD3E exon4_T44 | 0.9 | 0.991 |
| ACACTGTGGG GGGTGGGGTG | 278 | ACACUGUGGG GGGUGGGGUG | 403 | CD3E exon4_T47 | 0.3 | 0.992 |
| CACACTGTGG GGGGTGGGGT | 279 | CACACUGUGG GGGGUGGGGU | 404 | CD3E exon4_T43 | 0.2 | 0.992 |
| GTGGGGGGTG GGGTGGGGAG | 280 | GUGGGGGGUG GGGUGGGGAG | 405 | CD3E exon4_T46 | 0 | 0.993 |
| ACACACTGTG GGGGGTGGGG | 281 | ACACACUGUG GGGGGUGGGG | 406 | CD3E exon4_T48 | 0 | 0.992 |
| GCACCCGCTCC TCGTGTCAC | 282 | GCACCCGCUC CUCGUGUCAC | 407 | CD3E exon4_T1 | | |
| GAGCAAGAAT AGAAAGGCCA | 283 | GAGCAAGAAU AGAAAGGCCA | 408 | CD3E exon4_T39 | | |

In some embodiments, a gRNA comprises the sequence of any one of SEQ ID NOs: 284-408 or targets the sequence of any one of SEQ ID NOs: 159-283.

B2M gRNA Screen

For B2M, genomic segments containing the first three (3) protein coding exons were used as input in the gRNA design software. The genomic segments also included flanking splice site acceptor/donor sequences. Desired gRNAs were those that would lead to insertions or deletions in the coding sequence disrupting the amino acid sequence of B2M leading to out of frame/loss of function allele(s). All forty nine (49) in silico-identified gRNA spacers targeting B2M were used in an IVT screen. All gRNAs yielded measurable data by TIDE analysis. Eight (8) gRNA sequences yielded InDel percentages above 50% that could be suitable for secondary screens.

A homology-dependent assessment of the B2M gRNA comprising SEQ ID NO: 466 showed that this guide had an indel frequency of less than 0.5% at an off-target site. This data guided selection of this particular B2M gRNA for further analysis.

TABLE 6

B2M target sequences, gRNA spacer sequences, and cutting efficiencies in HEK293T cells

| Target Sequence | SEQ ID NO: | gRNA Spacer | SEQ ID NO: | Guide Name | Indel % | $R^2$ |
|---|---|---|---|---|---|---|
| TCCTGAAGCTG ACAGCATTC | 409 | UCCUGAAGCU GACAGCAUUC | 458 | B2M EXON1_T13 | 89.5 | 0.924 |
| CAGTAAGTCAA CTTCAATGT | 410 | CAGUAAGUC AACUUCAAU GU | 459 | B2M EXON2_T9 | 80.4 | 0.966 |

TABLE 6-continued

B2M target sequences, gRNA spacer sequences, and cutting efficiencies in HEK293T cells

| Target Sequence | SEQ ID NO: | gRNA Spacer | SEQ ID NO: | Guide Name | Indel % | $R^2$ |
|---|---|---|---|---|---|---|
| GGCCGAGATGT CTCGCTCCG | 411 | GGCCGAGAU GUCUCGCUCC G | 460 | B2M EXON1_T2 | 70.7 | 0.99 |
| ACAAAGTCACA TGGTTCACA | 412 | ACAAAGUCAC AUGGUUCAC A | 461 | B2M EXON2_T23 | 65.5 | 0.972 |
| CGCGAGCACA GCTAAGGCCA | 413 | CGCGAGCACA GCUAAGGCCA | 462 | B2M EXON1_T11 | 60.3 | 0.972 |
| CATACTCATCT TTTTCAGTG | 414 | CAUACUCAUC UUUUUCAGU G | 463 | B2M EXON2_T24 | 59.9 | 0.989 |
| ACTCTCTCTTT CTGGCCTGG | 415 | ACUCUCUCUU UCUGGCCUGG | 464 | B2M EXON1_T19 | 57.1 | 0.96 |
| CTCGCGCTACT CTCTCTTTC | 416 | CUCGCGCUAC UCUCUCUUUC | 465 | B2M EXON1_T12 | 54.8 | 0.812 |
| GCTACTCTCTC TTTCTGGCC | 417 | GCUACUCUCU CUUUCUGGCC | 466 | B2M EXON1_T20 | 45.9 | 0.867 |
| TCTCTCCTACC CTCCCGCTC | 418 | UCUCUCCUAC CCUCCCGCUC | 467 | B2M EXON1_T15 | 43.5 | 0.968 |
| CAGCCCAAGAT AGTTAAGTG | 419 | CAGCCCAAGA UAGUUAAGU G | 468 | B2M EXON2_T5 | 42.7 | 0.988 |
| TCACGTCATCC AGCAGAGAA | 420 | UCACGUCAUC CAGCAGAGA A | 469 | B2M EXON2_T17 | 39.8 | 0.974 |
| TTACCCCACTT AACTATCTT | 421 | UUACCCCACU UAACUAUCU U | 470 | B2M EXON2_T11 | 32.7 | 0.977 |
| GGCCACGGAG CGAGACATCT | 422 | GGCCACGGAG CGAGACAUCU | 471 | B2M EXON1_T8 | 32.1 | 0.99 |
| CTTACCCCACT TAACTATCT | 423 | CUUACCCCAC UUAACUAUC U | 472 | B2M EXON2_T7 | 31.9 | 0.984 |
| GGCATACTCAT CTTTTTCAG | 424 | GGCAUACUCA UCUUUUUCA G | 473 | B2M EXON2_T15 | 31.7 | 0.985 |
| TATAAGTGGAG GCGTCGCGC | 425 | UAUAAGUGG AGGCGUCGCG C | 474 | B2M EXON1_T1 | 31.6 | 0.991 |
| GCCCGAATGCT GTCAGCTTC | 426 | GCCCGAAUGC UGUCAGCUUC | 475 | B2M EXON1_T10 | 30.5 | 0.99 |
| GAAGTTGACTT ACTGAAGAA | 427 | GAAGUUGAC UUACUGAAG AA | 476 | B2M EXON2_T19 | 30.4 | 0.98 |
| GAGGAAGGAC AGAGCGGGA | 428 | GAGGAAGGA CCAGAGCGGG A | 477 | B2M EXON1_T18 | 28.9 | 0.993 |
| AAGTGGAGGC GTCGCGCTGG | 429 | AAGUGGAGG CGUCGCGCUG G | 478 | B2M EXON1_T4 | 27.1 | 0.983 |
| ACTCACGCTGG ATAGCCTCC | 430 | ACUCACGCUG GAUAGCCUCC | 479 | B2M EXON1_T7 | 22.3 | 0.992 |

TABLE 6-continued

B2M target sequences, gRNA spacer sequences, and cutting efficiencies in HEK293T cells

| Target Sequence | SEQ ID NO: | gRNA Spacer | SEQ ID NO: | Guide Name | Indel % | $R^2$ |
|---|---|---|---|---|---|---|
| GAGTAGCGCGAGCACAGCTA | 431 | GAGUAGCGCGAGCACAGCUA | 480 | B2M EXON1_T5 | 20.8 | 0.97 |
| AGGGTAGGAGAGACTCACGC | 432 | AGGGUAGGAGAGACUCACGC | 481 | B2M EXON1_T9 | 19.9 | 0.993 |
| TTCAGACTTGTCTTTCAGCA | 433 | UUCAGACUUGUCUUUCAGCA | 482 | B2M EXON2_T21 | 18.9 | 0.991 |
| CACAGCCCAAGATAGTTAAG | 434 | CACAGCCCAAGAUAGUUAAG | 483 | B2M EXON2_T6 | 18.6 | 0.991 |
| TTGGAGTACCTGAGGAATAT | 435 | UUGGAGUACCUGAGGAAUAU | 484 | B2M EXON2_T26 | 18.1 | 0.99 |
| AAGGACCAGAGCGGGAGGGT | 436 | AAGGACCAGAGCGGGAGGGU | 485 | B2M EXON1_T16 | 17.4 | 0.994 |
| AGAGGAAGGACCAGAGCGGG | 437 | AGAGGAAGGACCAGAGCGGG | 486 | B2M EXON1_T17 | 17.4 | 0.992 |
| AAGTCAACTTCAATGTCGGA | 438 | AAGUCAACUUCAAUGUCGGA | 487 | B2M EXON2_T2 | 15.2 | 0.981 |
| AGTGGAGGCGTCGCGCTGGC | 439 | AGUGGAGGCGUCGCGCUGGC | 488 | B2M EXON1_T3 | 14.2 | 0.995 |
| TGGAGTACCTGAGGAATATC | 440 | UGGAGUACCUGAGGAAUAUC | 489 | B2M EXON2_T12 | 11.7 | 0.98 |
| ACAGCCCAAGATAGTTAAGT | 441 | ACAGCCCAAGAUAGUUAAGU | 490 | B2M EXON2_T4 | 11.5 | 0.995 |
| CGTGAGTAAACCTGAATCTT | 442 | CGUGAGUAAACCUGAAUCUU | 491 | B2M EXON2_T3 | 10.4 | 0.99 |
| TGGAGAGAGAATTGAAAAAG | 443 | UGGAGAGAGAAUUGAAAAAG | 492 | B2M EXON2_T28 | 9.2 | 0.993 |
| ATACTCATCTTTTTCAGTGG | 444 | AUACUCAUCUUUUUCAGUGG | 493 | B2M EXON2_T25 | 8 | 0.988 |
| AGTCACATGGTTCACACGGC | 445 | AGUCACAUGGUUCACACGGC | 494 | B2M EXON2_T1 | 6.4 | 0.99 |
| CACGCGTTTAATATAAGTGG | 446 | CACGCGUUUAAUAUAAGUGG | 495 | B2M EXON1_T6 | 5.2 | 0.99 |
| CTCAGGTACTCCAAAGATTC | 447 | CUCAGGUACUCCAAAGAUUC | 496 | B2M EXON2_T8 | 5 | 0.99 |
| TTTGACTTTCCATTCTCTGC | 448 | UUUGACUUUCCAUUCUCUGC | 497 | B2M EXON2_T27 | 4.8 | 0.991 |

TABLE 6-continued

B2M target sequences, gRNA spacer sequences, and cutting efficiencies in HEK293T cells

| Target Sequence | SEQ ID NO: | gRNA Spacer | SEQ ID NO: | Guide Name | Indel % | $R^2$ |
|---|---|---|---|---|---|---|
| ACCCAGACACATAGCAATTC | 449 | ACCCAGACACAUAGCAAUUC | 498 | B2M EXON2_T13 | 4.7 | 0.992 |
| TGGGCTGTGACAAAGTCACA | 450 | UGGGCUGUGACAAAGUCACA | 499 | B2M EXON2_T22 | 4.4 | 0.993 |
| CTGAATCTTTGGAGTACCTG | 451 | CUGAAUCUUUGGAGUACCUG | 500 | B2M EXON2_T14 | 3 | 0.993 |
| TTCCTGAATTGCTATGTGTC | 452 | UUCCUGAAUUGCUAUGUGUC | 501 | B2M EXON2_T16 | 3 | 0.992 |
| ACTTGTCTTTCAGCAAGGAC | 453 | ACUUGUCUUUCAGCAAGGAC | 502 | B2M EXON2_T10 | 2.8 | 0.992 |
| TTCCTGAAGCTGACAGCATT | 454 | UUCCUGAAGCUGACAGCAUU | 503 | B2M EXON1_T14 | 2.5 | 0.994 |
| GCATACTCATCTTTTTCAGT | 455 | GCAUACUCAUCUUUUUCAGU | 504 | B2M EXON2_T20 | 2.4 | 0.988 |
| TCCTGAATTGCTATGTGTCT | 456 | UCCUGAAUUGCUAUGUGUCU | 505 | B2M EXON2_T18 | 1.9 | 0.99 |
| TCATAGATCGAGACATGTAA | 457 | UCAUAGAUCGAGACAUGUAA | 506 | B2M EXON3_T1 | 1.5 | 0.992 |

In some embodiments, a gRNA comprises the sequence of any one of SEQ ID NOs: 458-506 or targets the sequence of any one of SEQ ID NOs: 409-457.

CIITA gRNA Screen

For CIITA, genomic segments containing the ATG exon downstream of the Type 3 promoter, the Type IV promoter/alternative exon 1, and the next three (3) downstream exons (here termed exon3-exon5) were used as input into the gRNA design software (see Muhlethaler-Mottet et al., 1997. EMBO J. 10, 2851-2860 for CIITA gene annotation). The genomic segments included protein coding regions and flanked splicing acceptor/donor sites as well as potential gene expression regulatory elements. Desired gRNAs were those that would lead to insertions or deletions in the coding sequence disrupting the amino acid sequence of CIITA leading to out of frame/loss of function allele(s). Only gRNAs without a perfect match elsewhere in the genome were screened. From a total of ~274 gRNA spacers targeting CIITA (identified in silico), one hundred ninety six (196) gRNA spacers were chosen for IVT screening. One hundred eighty (180) sgRNAs yielded measurable data by TIDE analysis. Eighty one (81) gRNA sequences yielded InDel percentages above 50% that could be suitable for secondary screens.

TABLE 7

CIITA target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| CTGGGGCCGCGGCAAGTCTG | 507 | CUGGGGCCGCGGCAAGUCUG | 699 | CIITA PIV_T19 | 93.4 | 0.992 |
| CTCCAGTCGGTTCCTCACAG | 508 | CUCCAGUCGGUUCCUCACAG | 700 | CIITA PIV_T22 | 90.4 | 0.978 |
| AGAGGTCTTGGATTCCTGCT | 509 | AGAGGUCUUGGAUUCCUGCU | 701 | CIITA PIV_T60 | 88.6 | 0.974 |

TABLE 7-continued

CIITA target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| GCCCTGCCGGT CCTTTTCAG | 510 | GCCCUGCCGG UCCUUUUCAG | 702 | CIITA PIV_T20 | 88.4 | 0.943 |
| AGACTCCGGGA GCTGCTGCC | 511 | AGACUCCGGG AGCUGCUGCC | 703 | CIITA P3_T27 | 87.5 | 0.99 |
| GTCACCTACCG CTGTTCCCC | 512 | GUCACCUACC GCUGUUCCCC | 704 | CIITA PIV_T25 | 87.1 | 0.97 |
| GCCTGGCTCCA CGCCCTGCT | 513 | GCCUGGCUCC ACGCCCUGCU | 705 | CIITA P3_T38 | 86.9 | 0.992 |
| CTGGGACTCTC CCCGAAGTG | 514 | CUGGGACUCU CCCCGAAGUG | 706 | CIITA PIV_T23 | 86.1 | 0.99 |
| GAGCTGCCACA GACTTGCCG | 515 | GAGCUGCCAC AGACUUGCCG | 707 | CIITA PIV_T7 | 84.9 | 0.99 |
| CTTGGATGCCC CAGGCAGTT | 516 | CUUGGAUGCC CCAGGCAGUU | 708 | CIITA PIV_T52 | 84.4 | 0.969 |
| TCTGCAAGTCC TGAGTTGCA | 517 | UCUGCAAGUC CUGAGUUGCA | 709 | CIITA PIV_T58 | 84.4 | 0.988 |
| GGGATACCGG AAGAGACCAG | 518 | GGGAUACCGG AAGAGACCAG | 710 | CIITA EXON3_T23 | 83.8 | 0.924 |
| GGTCACCTACC GCTGTTCCC | 519 | GGUCACCUAC CGCUGUUCCC | 711 | CIITA PIV_T6 | 83.2 | 0.899 |
| ACAATGCTCAG TCACCTCAC | 520 | ACAAUGCUCA GUCACCUCAC | 712 | CIITA EXON3_T14 | 83.1 | 0.943 |
| GGAGCCCGGG GAACAGCGGT | 521 | GGAGCCCGGG GAACAGCGGU | 713 | CIITA PIV_T56 | 82.8 | 0.86 |
| GGCCACTGTGA GGAACCGAC | 522 | GGCCACUGUG AGGAACCGAC | 714 | CIITA PIV_T12 | 82.5 | 0.929 |
| TGGAGATGCCA GCAGAAGTT | 523 | UGGAGAUGCC AGCAGAAGU U | 715 | CIITA EXON5_T8 | 82.3 | 0.966 |
| ATAGGACCAG ATGAAGTGAT | 524 | AUAGGACCAG AUGAAGUGA U | 716 | CIITA EXON5_T12 | 82 | 0.977 |
| CTTCTGAGCTG GGCATCCGA | 525 | CUUCUGAGCU GGGCAUCCGA | 717 | CIITA P3_T11 | 81.6 | 0.964 |
| TCCTACCTGTC AGAGCCCCA | 526 | UCCUACCUGU CAGAGCCCCA | 718 | CIITA P3_T18 | 81.2 | 0.961 |
| GCCCAGAAAA GGACAATCAA | 527 | GCCCAGAAAA GGACAAUCAA | 719 | CIITA EXON4_T22 | 81 | 0.928 |
| GAGGTGGTTTG CCACTTTCA | 528 | GAGGUGGUU UGCCACUUUC A | 720 | CIITA PIV_T41 | 80.2 | 0.943 |
| GAAGCTGAGG GCACGAGGAG | 529 | GAAGCUGAG GGCACGAGGA G | 721 | CIITA P3_T35 | 80 | 0.942 |
| GGCTTATGCCA ATATCGGTG | 530 | GGCUUAUGCC AAUAUCGGU G | 722 | CIITA EXON4_T1 | 79.8 | 0.938 |
| CTCCTCTGATG CTGGCCCTA | 531 | CUCCUCUGAU GCUGGCCCUA | 723 | CIITA PIV_T46 | 79.7 | 0.941 |
| GGATACCGGA AGAGACCAGA | 532 | GGAUACCGGA AGAGACCAGA | 724 | CIITA EXON3_T25 | 79.3 | 0.872 |

TABLE 7-continued

CIITA target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| GGACAAGCTCC CTGCAACTC | 533 | GGACAAGCUC CCUGCAACUC | 725 | CIITA PIV_T51 | 78.8 | 0.976 |
| CATCCATGGAA GGTACCTGA | 534 | CAUCCAUGGA AGGUACCUGA | 726 | CIITA PIV_T33 | 78.5 | 0.929 |
| TAGCTCAGTTA GCTCATCTC | 535 | UAGCUCAGUU AGCUCAUCUC | 727 | CIITA PIV_T27 | 77.1 | 0.962 |
| GATATTGGCAT AAGCCTCCC | 536 | GAUAUUGGC AUAAGCCUCC C | 728 | CIITA EXON4_T7 | 75.5 | 0.931 |
| TAGTGATGAGG CTAGTGATG | 537 | UAGUGAUGA GGCUAGUGA UG | 729 | CIITA P3_T21 | 74.8 | 0.945 |
| GAAGTGGCATC CCAACTGCC | 538 | GAAGUGGCA UCCCAACUGC C | 730 | CIITA PIV_T28 | 74.3 | 0.965 |
| GCTCAGTTAGC TCATCTCAG | 539 | GCUCAGUUAG CUCAUCUCAG | 731 | CIITA PIV_T43 | 74.2 | 0.985 |
| AGGTGATGAA GAGACCAGGG | 540 | AGGUGAUGA AGAGACCAGG G | 732 | CIITA EXON4_T25 | 73.9 | 0.871 |
| GAGGCCACCA GCAGCGCGCG | 541 | GAGGCCACCA GCAGCGCGCG | 733 | CIITA PIV_T26 | 73.3 | 0.987 |
| TTCTAGGGGCC CCAACTCCA | 542 | UUCUAGGGGC CCCAACUCCA | 734 | CIITA EXON3_T29 | 73.3 | 0.867 |
| AGTCTCCTCTG TAACCCCTA | 543 | AGUCUCCUCU GUAACCCCUA | 735 | CIITA PIV_T44 | 72.3 | 0.925 |
| AAGTGGCAAA CCACCTCCGA | 544 | AAGUGGCAA ACCACCUCCG A | 736 | CIITA PIV_T3 | 72.2 | 0.947 |
| TTTTACCTTGG GGCTCTGAC | 545 | UUUUACCUUG GGGCUCUGAC | 737 | CIITA P3_T8 | 71.7 | 0.968 |
| GGTCCATCTGG TCATAGAAG | 546 | GGUCCAUCUG GUCAUAGAA G | 738 | CIITA EXON3_T6 | 71.5 | 0.881 |
| GAGCAACCAA GCACCTACTG | 547 | GAGCAACCAA GCACCUACUG | 739 | CIITA PIV_T32 | 71.1 | 0.887 |
| TCGTGCCCTCA GCTTCCCCA | 548 | UCGUGCCCUC AGCUUCCCCA | 740 | CIITA P3_T28 | 70.6 | 0.96 |
| ACTTCTGATAA AGCACGTGG | 549 | ACUUCUGAUA AAGCACGUGG | 741 | CIITA PIV_T17 | 70.4 | 0.939 |
| ATGGAGTTGGG GCCCCTAGA | 550 | AUGGAGUUG GGGCCCCUAG A | 742 | CIITA EXON3_T30 | 68.7 | 0.983 |
| AGCCCAGAAA AGGACAATCA | 551 | AGCCCAGAAA AGGACAAUCA | 743 | CIITA EXON4_T21 | 68.6 | 0.805 |
| TAGGGGCCCCA ACTCCATGG | 552 | UAGGGGCCCC AACUCCAUGG | 744 | CIITA EXON3_T20 | 68.5 | 0.77 |
| GTGGCACACTG TGAGCTGCC | 553 | GUGGCACACU GUGAGCUGCC | 745 | CIITA EXON3_T24 | 68 | 0.938 |
| GAAGCACCTGA GCCCAGAAA | 554 | GAAGCACCUG AGCCCAGAAA | 746 | CIITA EXON4_T27 | 66.6 | 0.695 |

TABLE 7-continued

CIITA target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| GTCAGAGCCCC AAGGTAAAA | 555 | GUCAGAGCCC CAAGGUAAA A | 747 | CIITA P3_T16 | 65.9 | 0.959 |
| GCTCCAGGTAG CCACCTTCT | 556 | GCUCCAGGUA GCCACCUUCU | 748 | CIITA EXON3_T16 | 65.8 | 0.856 |
| CTTTCACGGTT GGACTGAGT | 557 | CUUUCACGGU UGGACUGAG U | 749 | CIITA PIV_T18 | 65.6 | 0.963 |
| GCCACTTCTGA TAAAGCACG | 558 | GCCACUUCUG AUAAAGCACG | 750 | CIITA PIV_T4 | 65.4 | 0.955 |
| AATCCCTCAGG TACCTTCCA | 559 | AAUCCCUCAG GUACCUUCCA | 751 | CIITA PIV_T61 | 64.5 | 0.866 |
| GTCTGTGGCAG CTCGTCCGC | 560 | GUCUGUGGCA GCUCGUCCGC | 752 | CIITA PIV_T1 | 64.4 | 0.981 |
| ACACTGTGAGC TGCCTGGGA | 561 | ACACUGUGAG CUGCCUGGGA | 753 | CIITA EXON3_T38 | 63.5 | 0.891 |
| AAAGTGGCAA ACCACCTCCG | 562 | AAAGUGGCA AACCACCUCC G | 754 | CIITA PIV_T2 | 61.9 | 0.973 |
| AGGCATCCTTG GGGAAGCTG | 563 | AGGCAUCCUU GGGGAAGCU G | 755 | CIITA P3_T32 | 61.6 | 0.95 |
| ACTCAGTCCAA CCGTGAAAG | 564 | ACUCAGUCCA ACCGUGAAAG | 756 | CIITA PIV_T11 | 61.5 | 0.964 |
| AGGGACCTCTT GGATGCCCC | 565 | AGGGACCUCU UGGAUGCCCC | 757 | CIITA PIV_T55 | 61.1 | 0.796 |
| AGCAAGGCTA GGTTGGATCA | 566 | AGCAAGGCUA GGUUGGAUC A | 758 | CIITA EXON5_T4 | 60.7 | 0.839 |
| GCCCTTGATTG TCCTTTTCT | 567 | GCCCUUGAUU GUCCUUUUCU | 759 | CIITA EXON4_T15 | 60.4 | 0.876 |
| GGAAGGTGAT GAAGAGACCA | 568 | GGAAGGUGA UGAAGAGACC A | 760 | CIITA EXON4_T26 | 59.8 | 0.7 |
| ACCACGTGCTT TATCAGAAG | 569 | ACCACGUGCU UUAUCAGAA G | 761 | CIITA PIV_T30 | 59.1 | 0.962 |
| ACCTTGGGGCT CTGACAGGT | 570 | ACCUUGGGGC UCUGACAGGU | 762 | CIITA P3_T17 | 58.6 | 0.972 |
| AGGTAGGACCC AGCAGGGCG | 571 | AGGUAGGACC CAGCAGGGCG | 763 | CIITA P3_T22 | 58.2 | 0.956 |
| GGGCATCCGAA GGCATCCTT | 572 | GGGCAUCCGA AGGCAUCCUU | 764 | CIITA P3_T2 | 58 | 0.96 |
| CAGTGGCCAGC CCCACTTCG | 573 | CAGUGGCCAG CCCCACUUCG | 765 | CIITA PIV_T36 | 57.6 | 0.804 |
| CCCAGCCAGGC AGCAGCTCC | 574 | CCCAGCCAGG CAGCAGCUCC | 766 | CIITA P3_T39 | 57.5 | 0.966 |
| GGCATCCGAAG GCATCCTTG | 575 | GGCAUCCGAA GGCAUCCUUG | 767 | CIITA P3_T10 | 57 | 0.855 |
| GCCTGGGACTC TCCCCGAAG | 576 | GCCUGGGACU CUCCCCGAAG | 768 | CIITA PIV_T24 | 56.6 | 0.889 |

TABLE 7-continued

CIITA target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
| --- | --- | --- | --- | --- | --- | --- |
| CACTGTGAGGAACCGACTGG | 577 | CACUGUGAGGAACCGACUGG | 769 | CIITA_PIV_T15 | 56 | 0.876 |
| AAAAGAACTGCGGGGAGGCG | 578 | AAAAGAACUGCGGGGAGGCG | 770 | CIITA_PIV_T66 | 55.9 | 0.968 |
| TGAGCATTGTCTTCCCTCCC | 579 | UGAGCAUUGUCUUCCCUCCC | 771 | CIITA_EXON3_T31 | 55.4 | 0.954 |
| CCTCAGGTACCTTCCATGGA | 580 | CCUCAGGUACCUUCCAUGGA | 772 | CIITA_PIV_T45 | 54.7 | 0.853 |
| CACACTGTGAGCTGCCTGGG | 581 | CACACUGUGAGCUGCCUGGG | 773 | CIITA_EXON3_T36 | 54.5 | 0.94 |
| CTTCTCCAGCCAGGTCCATC | 582 | CUUCUCCAGCCAGGUCCAUC | 774 | CIITA_EXON3_T17 | 54 | 0.885 |
| GGAAGAGACCAGAGGGAGGA | 583 | GGAAGAGACCAGAGGGAGGA | 775 | CIITA_EXON3_T44 | 53.5 | 0.958 |
| AGCCAGGCAACGCATTGTGT | 584 | AGCCAGGCAACGCAUUGUGU | 776 | CIITA_P3_T1 | 53.4 | 0.972 |
| AAGGCTAGGTTGGATCAGGG | 585 | AAGGCUAGGUUGGAUCAGGG | 777 | CIITA_EXON5_T6 | 52.6 | 0.878 |
| CCTGGGACTCTCCCCGAAGT | 586 | CCUGGGACUCUCCCCGAAGU | 778 | CIITA_PIV_T9 | 52.3 | 0.745 |
| ACAGTGTGCCACCATGGAGT | 587 | ACAGUGUGCCACCAUGGAGU | 779 | CIITA_EXON3_T4 | 51.6 | 0.938 |
| GGCTAGGTTGGATCAGGGAG | 588 | GGCUAGGUUGGAUCAGGGAG | 780 | CIITA_EXON5_T11 | 50.4 | 0.91 |
| CTCCAAGGCATGAGACTTTG | 589 | CUCCAAGGCAUGAGACUUUG | 781 | CIITA_PIV_T67 | 50.3 | 0.975 |
| GCCCCTAGAAGGTGGCTACC | 590 | GCCCCUAGAAGGUGGCUACC | 782 | CIITA_EXON3_T2 | 50.1 | 0.936 |
| CTGACAGGTAGGACCCAGCA | 591 | CUGACAGGUAGGACCCAGCA | 783 | CIITA_P3_T19 | 48.3 | 0.952 |
| GCAGGGCTCTTGCCACGGCT | 592 | GCAGGGCUCUUGCCACGGCU | 784 | CIITA_PIV_T21 | 47.9 | 0.963 |
| GAGCCCAAGGTAAAAGGC | 593 | GAGCCCAAGGUAAAAGGC | 785 | CIITA_P3_T9 | 47.6 | 0.958 |
| GCTATTCACTCCTCTGATGC | 594 | GCUAUUCACUCCUCUGAUGC | 786 | CIITA_PIV_T39 | 47.4 | 0.965 |
| CATCGCTGTTAAGAAGCTCC | 595 | CAUCGCUGUUAAGAAGCUCC | 787 | CIITA_EXON3_T1 | 46.7 | 0.703 |
| GGGTGTGGTCATGGTAACAC | 596 | GGGUGUGGUCAUGGUAACAC | 788 | CIITA_PIV_T53 | 46.2 | 0.956 |
| AAGTGGCATCCCAACTGCCT | 597 | AAGUGGCAUCCCAACUGCCU | 789 | CIITA_PIV_T63 | 45.9 | 0.968 |

TABLE 7-continued

CIITA target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| GGGAAGCTGAGGGCACGAGG | 598 | GGGAAGCUGAGGGCACGAGG | 790 | CIITA P3_T36 | 45.8 | 0.965 |
| CTTCTATGACCAGATGGACC | 599 | CUUCUAUGACCAGAUGGACC | 791 | CIITA EXON3_T11 | 45.5 | 0.892 |
| CTCCAGGTAGCCACCTTCTA | 600 | CUCCAGGUAGCCACCUUCUA | 792 | CIITA EXON3_T7 | 45.2 | 0.857 |
| GGAAGCTGAGGGCACGAGGA | 601 | GGAAGCUGAGGGCACGAGGA | 793 | CIITA P3_T37 | 45 | 0.86 |
| CAATGCTCAGTCACCTCACA | 602 | CAAUGCUCAGUCACCUCACA | 794 | CIITA EXON3_T27 | 44.7 | 0.95 |
| CTTTCCCGGCCTTTTTACCT | 603 | CUUUCCCGGCCUUUUUACCU | 795 | CIITA P3_T14 | 43.7 | 0.931 |
| GCTGAACTGGTCGCAGTTGA | 604 | GCUGAACUGGUCGCAGUUGA | 796 | CIITA EXON4_T3 | 43.4 | 0.923 |
| TTGCAGATCACTTGCCCAAG | 605 | UUGCAGAUCACUUGCCCAAG | 797 | CIITA PIV_T49 | 43.1 | 0.982 |
| CTCCTCCCTCTGGTCTCTTC | 606 | CUCCUCCCUCUGGUCUCUUC | 798 | CIITA EXON3_T42 | 42.4 | 0.872 |
| TTCCTACACAATGCGTTGCC | 607 | UUCCUACACAAUGCGUUGCC | 799 | CIITA P3_T3 | 42.3 | 0.95 |
| TTGGGGAAGCTGAGGGCACG | 608 | UUGGGGAAGCUGAGGGCACG | 800 | CIITA P3_T34 | 42 | 0.975 |
| TCCAGGTAGCCACCTTCTAG | 609 | UCCAGGUAGCCACCUUCUAG | 801 | CIITA EXON3_T9 | 41.4 | 0.746 |
| TGAAGTGATCGGTGAGAGTA | 610 | UGAAGUGAUCGGUGAGAGUA | 802 | CIITA EXONS_T1 | 39.3 | 0.974 |
| CCTCTTTCCAACACCCTGTG | 611 | CCUCUUUCCAACACCCUGUG | 803 | CIITA EXON3_T33 | 39.1 | 0.711 |
| ACCTCTGAAAAGGACCGGCA | 612 | ACCUCUGAAAAGGACCGGCA | 804 | CIITA PIV_T10 | 38.9 | 0.981 |
| GTGAGGAACCGACTGGAGGC | 613 | GUGAGGAACCGACUGGAGGC | 805 | CIITA PIV_T42 | 38.2 | 0.969 |
| GGGCCATGTGCCCTCGGAGG | 614 | GGGCCAUGUGCCCUCGGAGG | 806 | CIITA PIV_T62 | 37.5 | 0.976 |
| AGGCTAGGTTGGATCAGGGA | 615 | AGGCUAGGUUGGAUCAGGGA | 807 | CIITA EXONS_T7 | 37.1 | 0.951 |
| TTCCCGGCCTTTTTACCTTG | 616 | UUCCCGGCCUUUUUACCUUG | 808 | CIITA P3_T13 | 36.5 | 0.983 |
| CAGAGGTCTTGGATTCCTGC | 617 | CAGAGGUCUUGGAUUCCUGC | 809 | CIITA PIV_T48 | 36.1 | 0.976 |
| ATAGAAGTGGTAGAGGCACA | 618 | AUAGAAGUGGUAGAGGCACA | 810 | CIITA EXON3_T41 | 36.1 | 0.979 |
| TTCTGGGAGGAAAAGTCCCT | 619 | UUCUGGGAGGAAAAGUCCCU | 811 | CIITA EXON4_T13 | 35.9 | 0.947 |

TABLE 7-continued

CIITA target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| TCTGACAGGTAGGACCCAGC | 620 | UCUGACAGGUAGGACCCAGC | 812 | CIITA_P3_T7 | 34.8 | 0.981 |
| GCAGTTGATGGTGTCTGTGT | 621 | GCAGUUGAUGGUGUCUGUGU | 813 | CIITA_EXON4_T19 | 34.8 | 0.937 |
| CCTCACAGGGTGTTGGAAAG | 622 | CCUCACAGGGUGUUGGAAAG | 814 | CIITA_EXON3_T26 | 34.4 | 0.952 |
| GACCGGCAGGGCTCTTGCCA | 623 | GACCGGCAGGGCUCUUGCCA | 815 | CIITA_PIV_T47 | 34.3 | 0.943 |
| TACCGGAAGAGACCAGAGGG | 624 | UACCGGAAGAGACCAGAGGG | 816 | CIITA_EXON3_T28 | 32.7 | 0.982 |
| TGGGCATCCGAAGGCATCCT | 625 | UGGGCAUCCGAAGGCAUCCU | 817 | CIITA_P3_T4 | 32.5 | 0.983 |
| GAGGAGGGGCTGCCAGACTC | 626 | GAGGAGGGGCUGCCAGACUC | 818 | CIITA_P3_T25 | 32.1 | 0.982 |
| GAAATTTCCTTCTTCATCCA | 627 | GAAAUUUCCUUCUUCAUCCA | 819 | CIITA_EXON4_T23 | 31.6 | 0.955 |
| AGATTGAGCTCTACTCAGGT | 628 | AGAUUGAGCUCUACUCAGGU | 820 | CIITA_EXON3_T3 | 31 | 0.946 |
| CAGCTCACAGTGTGCCACCA | 629 | CAGCUCACAGUGUGCCACCA | 821 | CIITA_EXON3_T15 | 30.7 | 0.968 |
| CTACCACTTCTATGACCAGA | 630 | CUACCACUUCUAUGACCAGA | 822 | CIITA_EXON3_T12 | 30.1 | 0.987 |
| CACCTCAAAGTCTCATGCCT | 631 | CACCUCAAAGUCUCAUGCCU | 823 | CIITA_PIV_T68 | 29.2 | 0.972 |
| AGGCTGTTGTGTGACATGGA | 632 | AGGCUGUUGUGUGACAUGGA | 824 | CIITA_EXON4_T14 | 28.2 | 0.9 |
| TCTGGTCATAGAAGTGGTAG | 633 | UCUGGUCAUAGAAGUGGUAG | 825 | CIITA_EXON3_T34 | 27.5 | 0.979 |
| AGTGTGCCACCATGGAGTTG | 634 | AGUGUGCCACCAUGGAGUUG | 826 | CIITA_EXON3_T18 | 27.3 | 0.961 |
| CAGTGTGCCACCATGGAGTT | 635 | CAGUGUGCCACCAUGGAGUU | 827 | CIITA_EXON3_T10 | 26.5 | 0.979 |
| CACACAACAGCCTGCTGAAC | 636 | CACACAACAGCCUGCUGAAC | 828 | CIITA_EXON4_T12 | 25.4 | 0.834 |
| GACTCTCCCCGAAGTGGGGC | 637 | GACUCUCCCCGAAGUGGGGC | 829 | CIITA_PIV_T13 | 24.5 | 0.963 |
| CAGGGCTCTTGCCACGGCTG | 638 | CAGGGCUCUUGCCACGGCUG | 830 | CIITA_PIV_T64 | 24.4 | 0.958 |
| AGGAGGGGCTGCCAGACTCC | 639 | AGGAGGGGCUGCCAGACUCC | 831 | CIITA_P3_T29 | 24 | 0.989 |
| TGGTTTGCCACTTTCACGGT | 640 | UGGUUUGCCACUUUCACGGU | 832 | CIITA_PIV_T8 | 24 | 0.99 |
| TTTCTCAAAGTAGAGCACAT | 641 | UUUCUCAAAGUAGAGCACAU | 833 | CIITA_EXON5_T10 | 23.1 | 0.947 |

TABLE 7-continued

CIITA target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
| --- | --- | --- | --- | --- | --- | --- |
| ACTTGCCGCGGCCCCAGAGC | 642 | ACUUGCCGCGGCCCCAGAGC | 834 | CIITA PIV_T50 | 22 | 0.991 |
| TCAGTCACCTCACAGGGTGT | 643 | UCAGUCACCUCACAGGGUGU | 835 | CIITA EXON3_T22 | 21.1 | 0.985 |
| AGGTGCTTCCTCACCGATAT | 644 | AGGUGCUUCCUCACCGAUAU | 836 | CIITA EXON4_T2 | 21 | 0.979 |
| TGGCACACTGTGAGCTGCCT | 645 | UGGCACACUGUGAGCUGCCU | 837 | CIITA EXON3_T32 | 20.9 | 0.968 |
| TGCCTGGCTCCACGCCCTGC | 646 | UGCCUGGCUCCACGCCCUGC | 838 | CIITA P3_T40 | 20.7 | 0.988 |
| CAGCAGGCTGTTGTGTGACA | 647 | CAGCAGGCUGUUGUGUGACA | 839 | CIITA EXON4_T10 | 20.6 | 0.981 |
| GCTCCCGCGCGCGCTGCTGG | 648 | GCUCCCGCGCGCGCUGCUGG | 840 | CIITA PIV_T54 | 20.5 | 0.994 |
| CATAGAAGTGGTAGAGGCAC | 649 | CAUAGAAGUGGUAGAGGCAC | 841 | CITTA EXON3_T19 | 20 | 0.962 |
| CAGGGGCCATGTGCCCTCGG | 650 | CAGGGGCCAUGUGCCCUCGG | 842 | CITTA PIV_T38 | 19.3 | 0.984 |
| CTCTCACCGATCACTTCATC | 651 | CUCUCACCGAUCACUUCAUC | 843 | CIITA EXON5_T2 | 18.2 | 0.981 |
| AGCTTCCCCAAGGATGCCTT | 652 | AGCUUCCCCAAGGAUGCCUU | 844 | CIITA P3_T12 | 16.7 | 0.987 |
| GACCTCTGAAAAGGACCGGC | 653 | GACCUCUGAAAAGGACCGGC | 845 | CIITA PIV_T5 | 16.6 | 0.988 |
| TGCCCTTGATTGTCCTTTTC | 654 | UGCCCUUGAUUGUCCUUUUC | 846 | CITTA EXON4_T11 | 16.6 | 0.911 |
| AGGCTGTGTGCTTCTGAGCT | 655 | AGGCUGUGUGCUUCUGAGCU | 847 | CITTA P3_T23 | 16.4 | 0.987 |
| CAGGTGGGCCCTCCTCCCTC | 656 | CAGGUGGGCCCUCCUCCCUC | 848 | CITTA EXON3_T39 | 16.1 | 0.987 |
| AGGGAGGCTTATGCCAATAT | 657 | AGGGAGGCUUAUGCCAAUAU | 849 | CITTA EXON4_T5 | 15.8 | 0.981 |
| AAACCACCTCCGAGGGCACA | 658 | AAACCACCUCCGAGGGCACA | 850 | CITTA PIV_T31 | 15.5 | 0.165 |
| AAATTTCCTTCTTCATCCAA | 659 | AAAUUUCCUUCUUCAUCCAA | 851 | CITTA EXON4_T24 | 14.3 | 0.964 |
| CAGTTGATGGTGTCTGTGTC | 660 | CAGUUGAUGGUGUCUGUGUC | 852 | CITTA EXON4_T17 | 13.3 | 0.985 |
| CCGGGAGCTGCTGCCTGGCT | 661 | CCGGGAGCUGCUGCCUGGCU | 853 | CIITA P3_T33 | 13.2 | 0.992 |
| GAAGAGATTGAGCTCTACTC | 662 | GAAGAGAUUGAGCUCUACUC | 854 | CITTA EXON3_T8 | 12.4 | 0.986 |
| TGGTGTCTGTGTCGGGTTCT | 663 | UGGUGUCUGUGUCGGGUUCU | 855 | CITTA EXON4_T8 | 12.4 | 0.959 |

TABLE 7-continued

CIITA target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| AGGCCACCAGC AGCGCGCGC | 664 | AGGCCACCAG CAGCGCGCGC | 856 | CITTA PIV_T14 | 12.1 | 0.995 |
| CCCACTTCGGG GAGAGTCCC | 665 | CCCACUUCGG GGAGAGUCCC | 857 | CITTA PIV_T29 | 11.3 | 0.978 |
| GAGGCTGTGTG CTTCTGAGC | 666 | GAGGCUGUG UGCUUCUGAG C | 858 | CIITA P3_T24 | 11.1 | 0.991 |
| CGGGCTCCCGC GCGCGCTGC | 667 | CGGGCUCCCG CGCGCGCUGC | 859 | CITTA PIV_T34 | 10.8 | 0.993 |
| TTTCCCGGCCT TTTTACCTT | 668 | UUUCCCGGCC UUUUUACCUU | 860 | CITTA P3_T20 | 9.7 | 0.992 |
| AGCTGAGGGGT GGGGGATAC | 669 | AGCUGAGGG GUGGGGGAU AC | 861 | CITTA EXON3_T37 | 8.8 | 0.981 |
| CCGGTCCTTTT CAGAGGTCT | 670 | CCGGUCCUUU UCAGAGGUCU | 862 | CITTA PIV_T37 | 8.6 | 0.984 |
| AAGCAAGGCT AGGTTGGATC | 671 | AAGCAAGGCU AGGUUGGAU C | 863 | CITTA EXON5_T3 | 8 | 0.965 |
| TGATTGTGTGA GTTGGTCTC | 672 | UGAUUGUGU GAGUUGGUC UC | 864 | CIITA EXON5_T5 | 7.7 | 0.974 |
| ATGGTGTCTGT GTCGGGTTC | 673 | AUGGUGUCU GUGUCGGGU UC | 865 | CIITA EXON4_T6 | 6.9 | 0.943 |
| AGGCAGCAGCT CCCGGAGTC | 674 | AGGCAGCAGC UCCCGGAGUC | 866 | CIITA P3_T15 | 6.5 | 0.986 |
| AGCCCCAAGGT AAAAAGGCC | 675 | AGCCCCAAGG UAAAAAGGCC | 867 | CIITA P3_T6 | 5.8 | 0.995 |
| TGCTTGGTTGC TCCACAGCC | 676 | UGCUUGGUU GCUCCACAGC C | 868 | CIITA PIV_T59 | 5.8 | 0.994 |
| ATCTGCAAGTC CTGAGTTGC | 677 | AUCUGCAAGU CCUGAGUUGC | 869 | CIITA PIV_T40 | 5.1 | 0.995 |
| ATTGTGTAGGA ATCCCAGCC | 678 | AUUGUGUAG GAAUCCCAGC C | 870 | CIITA P3_T5 | 4.6 | 0.993 |
| GGCAGGGCTCT TGCCACGGC | 679 | GGCAGGGCUC UUGCCACGGC | 871 | CIITA PIV_T16 | 4.2 | 0.985 |
| TCCGGGAGCTG CTGCCTGGC | 680 | UCCGGGAGCU GCUGCCUGGC | 872 | CIITA P3_T30 | 3.9 | 0.993 |
| GGCATCCTTGG GGAAGCTGA | 681 | GGCAUCCUUG GGGAAGCUG A | 873 | CIITA P3_T26 | 3.6 | 0.99 |
| TATGACCAGAT GGACCTGGC | 682 | UAUGACCAGA UGGACCUGGC | 874 | CIITA EXON3_T13 | 3.5 | 0.991 |
| AGGGCTCTTGC CACGGCTGG | 683 | AGGGCUCUUG CCACGGCUGG | 875 | CIITA PIV_T35 | 2.9 | 0.959 |
| CAATCTCTTCT TCTCCAGCC | 684 | CAAUCUCUUC UUCUCCAGCC | 876 | CIITA EXON3_T40 | 1.5 | 0.99 |
| ACCCAGCAGG GCGTGGAGCC | 685 | ACCCAGCAGG GCGUGGAGCC | 877 | CIITA P3_T31 | 0.7 | 0.995 |

TABLE 7-continued

CIITA target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| CTTTTCTGCCC AACTTCTGC | 686 | CUUUUCUGCC CAACUUCUGC | 878 | CIITA EXON5_T9 | 0.2 | 0.993 |
| AGCTCAGTTAG CTCATCTCA | 687 | AGCUCAGUUA GCUCAUCUCA | 879 | CIITA PIV_T57 | | |
| AGGGAAAAAG AACTGCGGGG | 688 | AGGGAAAAA GAACUGCGGG G | 880 | CIITA PIV_T65 | | |
| GAGATTGAGCT CTACTCAGG | 689 | GAGAUUGAG CUCUACUCAG G | 881 | CIITA EXON3_T5 | | |
| GAGTTGGGGCC CCTAGAAGG | 690 | GAGUUGGGG CCCCUAGAAG G | 882 | CIITA EXON3_T21 | | |
| TAGAAGTGGTA GAGGCACAG | 691 | UAGAAGUGG UAGAGGCACA G | 883 | CIITA EXON3_T35 | | |
| AGAAGTGGTA GAGGCACAGG | 692 | AGAAGUGGU AGAGGCACAG G | 884 | CIITA EXON3_T43 | | |
| CGGAAGAGAC CAGAGGGAGG | 693 | CGGAAGAGAC CAGAGGGAG G | 885 | CIITA EXON3_T45 | | |
| TCAACTGCGAC CAGTTCAGC | 694 | UCAACUGCGA CCAGUUCAGC | 886 | CIITA EXON4_T4 | | |
| TGTCTGTGTCG GGTTCTGGG | 695 | UGUCUGUGUC GGGUUCUGG G | 887 | CITTA EXON4_T9 | | |
| GATTGTCCTTT TCTGGGCTC | 696 | GAUUGUCCUU UUCUGGGCUC | 888 | CITTA EXON4_T16 | | |
| AAAAGTCCCTT GGATGAAGA | 697 | AAAAGUCCCU UGGAUGAAG A | 889 | CITTA EXON4_T18 | | |
| TGGAAGGTGAT GAAGAGACC | 698 | UGGAAGGUG AUGAAGAGA CC | 890 | CITTA EXON4_T20 | | |

In some embodiments, a gRNA comprises the sequence of any one of SEQ ID NOs: 699-890 or targets the sequence of any one of SEQ ID NOs: 507-698.

PD1 gRNA Screen

For PDCD1 (PD1), genomic segments containing the first three (3) protein coding exons were used as input in the gRNA design software. The genomic segments also included flanking splice site acceptor/donor sequences. Desired gRNAs were those that would lead to insertions or deletions in the coding sequence disrupting the amino acid sequence of PDCD1 leading to out of frame/loss of function allele(s). One hundred ninety two (192) in silico identified gRNA spacers targeting PDCD1 were used in an IVT screen. One hundred ninety (190) yielded measurable data by TIDE analysis. Forty (40) gRNA sequences yielded InDel percentages above 50% that could be suitable for secondary screens.

TABLE 8

PD1 target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| TGTCTGGGAGT CTGAGAGA | 891 | UGUCUGGGAG UCUGAGAGA | 1083 | PD1 EXON2_T84 | 94.7 | 0.96 |
| ACTGCTCAGGCG GAGGTGAGCGG | 892 | ACUGCUCAGGC GGAGGUGAG | 1084 | PD1 EXON1_T40 | 84.4 | 0.977 |

TABLE 8-continued

PD1 target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| CGCAGATCAAAGAGAGCCTG | 893 | CGCAGAUCAAAGAGAGCCUG | 1085 | PD1 EXON2_T51 | 83.1 | 0.894 |
| CTGCAGCTTCTCCAACACAT | 894 | CUGCAGCUUCUCCAACACAU | 1086 | PD1 EXON2_T57 | 82.4 | 0.9 |
| GCCCTGGCCAGTCGTCTGGGCGG | 895 | CGCCUUCUCCACUGCUCAGG | 1087 | PD1 EXON1_T23 | 80.8 | 0.961 |
| CAGCGGCACCTACCTCTGTG | 896 | CAGCGGCACCUACCUCUGUG | 1088 | PD1 EXON2_T50 | 77.7 | 0.928 |
| CTTCTCCACTGCTCAGGCGGAGG | 897 | ACGACUGGCCAGGGCGCCUG | 1089 | PD1 EXON1_T29 | 77.2 | 0.919 |
| GTTGGAGAAGCTGCAGGTGA | 898 | GUUGGAGAAGCUGCAGGUGA | 1090 | PD1 EXON2_T94 | 76.7 | 0.92 |
| CGTGTCACACAACTGCCCAA | 899 | CGUGUCACACAACUGCCCAA | 1091 | PD1 EXON2_T33 | 71.4 | 0.842 |
| CAGTGGAGAAGGCGGCACTCTGG | 900 | GGAGAAGGCGGCACUCUGGU | 1092 | PD1 EXON1_T19 | 70.3 | 0.924 |
| CGCCTGAGCAGTGGAGAAGGCGG | 901 | GCUCACCUCCGCCUGAGCAG | 1093 | PD1 EXON1_T37 | 66.6 | 0.885 |
| CCCTTCGGTCACCACGAGCA | 902 | CCCUUCGGUCACCACGAGCA | 1094 | PD1 EXON2_T14 | 66.2 | 0.867 |
| GGCGCCCTGGCCAGTCGTCTGGG | 903 | UCUUAGGUAGGUGGGGUCGG | 1095 | PD1 EXON1_T7 | 65.8 | 0.804 |
| GTCTGGGCGGTGCTACAACTGGG | 904 | CGACUGGCCAGGGCGCCUGU | 1096 | PD1 EXON1_T3 | 65.5 | 0.856 |
| GGAGAAGGCGGCACTCTGGTGGG | 905 | CGGUGCUACAACUGGGCUGG | 1097 | PD1 EXON1_T13 | 65.1 | 0.945 |
| TGCCGCTTCTCCACTGCTCAGG | 906 | CUCAGGCGGAGGUGAGCGGA | 1098 | PD1 EXON1_T32 | 63.4 | 0.876 |
| GGAGTCTGAGAGATGGAGAG | 907 | GGAGUCUGAGAGAUGGAGAG | 1099 | PD1 EXON2_T86 | 63.4 | 0.86 |
| GCCCACGACACCAACCACCA | 908 | GCCCACGACACCAACCACCA | 1100 | PD1 EXON3_T17 | 62.2 | 0.859 |
| CCAGGGAGATGGCCCCACAG | 909 | CCAGGGAGAUGGCCCCACAG | 1101 | PD1 EXON2_T70 | 60.6 | 0.87 |
| GCTCACCTCCGCCTGAGCAGTGG | 910 | AGGCGCCCUGGCCAGUCGUC | 1102 | PD1 EXON1_T25 | 60.2 | 0.858 |
| GCAGATCAAAGAGAGCCTGC | 911 | GCAGAUCAAAGAGAGCCUGC | 1103 | PD1 EXON2_T52 | 58.4 | 0.701 |
| GGAGAAGCTGCAGGTGAAGG | 912 | GGAGAAGCUGCAGGUGAAGG | 1104 | PD1 EXON2_T99 | 58.4 | 0.88 |
| CATGAGCCCCAGCAACCAGA | 913 | CAUGAGCCCCAGCAACCAGA | 1105 | PD1 EXON2_T56 | 58.1 | 0.908 |
| TGGAAGGGCACAAAGGTCAG | 914 | UGGAAGGGCACAAAGGUCAG | 1106 | PD1 EXON3_T36 | 58.1 | 0.786 |
| GAGCCTGCGGGCAGAGCTCA | 915 | GAGCCUGCGGGCAGAGCUCA | 1107 | PD1 EXON2_T72 | 57.9 | 0.75 |
| CGCCCACGACACCAACCACC | 916 | CGCCCACGACACCAACCACC | 1108 | PD1 EXON3_T8 | 56 | 0.855 |

TABLE 8-continued

PD1 target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| TGGAGAAGGCGGCACTCTGGTGG | 917 | GAGAAGGCGGCACUCUGGUG | 1109 | PD1 EXON1_T20 | 55.6 | 0.743 |
| TCCAGGCATGCAGATCCCACAGG | 918 | CAGUGGAGAAGGCGGCACUC | 1110 | PD1 EXON1_T28 | 55.5 | 0.725 |
| GACAGCGGCACCTACCTCTG | 919 | GACAGCGGCACCUACCUCUG | 1111 | PD1 EXON2_T44 | 53.6 | 0.794 |
| GAGAAGGCGGCACTCTGGTGGG | 920 | GGGCGGUGCUACAACUGGGC | 1112 | PD1 EXON1_T18 | 52.7 | 0.864 |
| GCTTGTCCGTCTGGTTGCTG | 921 | GCUUGUCCGUCUGGUUGCUG | 1113 | PD1 EXON2_T37 | 52.5 | 0.584 |
| CCTCTGTGGGGCCATCTCCC | 922 | CCUCUGUGGGGCCAUCUCCC | 1114 | PD1 EXON2_T66 | 52.2 | 0.787 |
| TGCAGATCCCACAGGCGCCCTGG | 923 | CUUCUCCACUGCUCAGGCGG | 1115 | PD1 EXON1_T30 | 52.1 | 0.862 |
| CACTCTGGTGGGGCTGCTCCAGG | 924 | UGGAGAAGGCGGCACUCUGG | 1116 | PD1 EXON1_T36 | 51.8 | 0.854 |
| GCAGTTGTGTGACACGGAAG | 925 | GCAGUUGUGUGACACGGAAG | 1117 | PD1 EXON2_T25 | 51.3 | 0.553 |
| TGTAGCACCGCCCAGACGACTGG | 926 | UGUAGCACCGCCCAGACGAC | 1118 | PD1 EXON1_T1 | 51.1 | 0.93 |
| GGCCATCTCCCTGGCCCCCA | 927 | GGCCAUCUCCCUGGCCCCCA | 1119 | PD1 EXON2_T88 | 50.9 | 0.86 |
| CCTGCTCGTGGTGACCGAAG | 928 | CCUGCUCGUGGUGACCGAAG | 1120 | PD1 EXON2_T13 | 50.8 | 0.914 |
| GGGGTTCCAGGGCCTGTCTG | 929 | GGGGUUCCAGGGCCUGUCUG | 1121 | PD1 EXON2_T78 | 50.8 | 0.74 |
| GGCCAGGATGGTTCTTAGGTAGG | 930 | CGUCUGGGCGGUGCUACAAC | 1122 | PD1 EXON1_T9 | 50.7 | 0.715 |
| TCAGGCGGAGGTGAGCGGAAGGG | 931 | GGCCAGGAUGGUUCUUAGGU | 1123 | PD1 EXON1_T26 | 48.8 | 0.913 |
| TCTGGTTGCTGGGGCTCATG | 932 | UCUGGUUGCUGGGGCUCAUG | 1124 | PD1 EXON2_T69 | 48.7 | 0.76 |
| CTTCTCCCCAGCCCTGCTCG | 933 | CUUCUCCCCAGCCCUGCUCG | 1125 | PD1 EXON2_T73 | 48.7 | 0.9 |
| CGACTGGCCAGGCGCCTGTGGG | 934 | GGUAGGUGGGGUCGGCGGUC | 1126 | PD1 EXON1_T11 | 48.4 | 0.868 |
| TTCTCTCTGGAAGGGCACAA | 935 | UUCUCUCUGGAAGGGCACAA | 1127 | PD1 EXON3_T31 | 48.2 | 0.969 |
| CCTGGCCGTCATCTGCTCCC | 936 | CCUGGCCGUCAUCUGCUCCC | 1128 | PD1 EXON3_T33 | 48.1 | 0.789 |
| CTCCGCCTGAGCAGTGGAGAAGG | 937 | UGCAGAUCCCACAGGCGCCC | 1129 | PD1 EXON1_T38 | 47.2 | 0.948 |
| CGTTGGGCAGTTGTGTGACA | 938 | CGUUGGGCAGUUGUGUGACA | 1130 | PD1 EXON2_T30 | 45.9 | 0.934 |
| GGATGGTTCTTAGGTAGGTGGGG | 939 | GUCUGGGCGGUGCUACAACU | 1131 | PD1 EXON1_T17 | 45.6 | 0.91 |
| GGTTCTTAGGTAGGTGGGGTCGG | 940 | CUACAACUGGGCUGGCGGCC | 1132 | PD1 EXON1_T35 | 45.4 | 0.917 |

TABLE 8-continued

PD1 target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
| --- | --- | --- | --- | --- | --- | --- |
| CGGTCACCACGAGCAGGGCT | 941 | CGGUCACCACGAGCAGGGCU | 1133 | PD1 EXON2_T34 | 45.3 | 0.917 |
| GCCTGTGGGATCTGCATGCCTGG | 942 | UGGCGGCCAGGAUGGUUCUU | 1134 | PD1 EXON1_T27 | 45.2 | 0.968 |
| CACCTACCTAAGAACCATCCTGG | 943 | GGCGCCCUGGCCAGUCGUCU | 1135 | PD1 EXON1_T10 | 44 | 0.827 |
| AGGCGCCCTGGCCAGTCGTCTGG | 944 | AGGAUGGUUCUUAGGUAGGU | 1136 | PD1 EXON1_T4 | 43.7 | 0.962 |
| GCGTGACTTCCACATGAGCG | 945 | GCGUGACUUCCACAUGAGCG | 1137 | PD1 EXON2_T6 | 42.9 | 0.941 |
| ACGACTGGCCAGGGCGCCTGTGG | 946 | CUCCGCCUGAGCAGUGGAGA | 1138 | PD1 EXON1_T24 | 42.8 | 0.925 |
| AGGGCCCGGCGCAATGACAG | 947 | AGGGCCCGGCGCAAUGACAG | 1139 | PD1 EXON2_T17 | 42.3 | 0.902 |
| TGGCGGCCAGGATGGTTCTTAGG | 948 | GCCUGUGGGAUCUGCAUGCC | 1140 | PD1 EXON1_T14 | 42.1 | 0.928 |
| GGTGACAGGTGCGGCCTCGG | 949 | GGUGACAGGUGCGGCCUCGG | 1141 | PD1 EXON2_T27 | 41.5 | 0.807 |
| GCCCTGCTCGTGGTGACCGA | 950 | GCCCUGCUCGUGGUGACCGA | 1142 | PD1 EXON2_T4 | 40.3 | 0.877 |
| CAGTTCCAAACCCTGGTGGT | 951 | CAGUUCCAAACCCUGGUGGU | 1143 | PD1 EXON3_T15 | 40.1 | 0.908 |
| CGATGTGTTGGAGAAGCTGC | 952 | CGAUGUGUUGGAGAAGCUGC | 1144 | PD1 EXON2_T54 | 39.6 | 0.926 |
| GTGTCACACAACTGCCCAAC | 953 | GUGUCACACAACUGCCCAAC | 1145 | PD1 EXON2_T26 | 38.6 | 0.907 |
| CAGGATGGTTCTTAGGTAGGTGG | 954 | GCCCUGGCCAGUCGUCUGGG | 1146 | PD1 EXON1_T21 | 38.4 | 0.964 |
| CCGGGCTGGCTGCGGTCCTC | 955 | CCGGGCUGGCUGCGGUCCUC | 1147 | PD1 EXON2_T38 | 37.6 | 0.838 |
| GCTGCGGTCCTCGGGGAAGG | 956 | GCUGCGGUCCUCGGGGAAGG | 1148 | PD1 EXON2_T67 | 37.6 | 0.897 |
| CGGGCTGGCTGCGGTCCTCG | 957 | CGGGCUGGCUGCGGUCCUCG | 1149 | PD1 EXON2_T36 | 36.3 | 0.813 |
| CGCCTTCTCCACTGCTCAGGCGG | 958 | ACCGCCCAGACGACUGGCCA | 1150 | PD1 EXON1_T33 | 36.1 | 0.487 |
| ACAGCGGCACCTACCTCTGT | 959 | ACAGCGGCACCUACCUCUGU | 1151 | PD1 EXON2_T42 | 35.8 | 0.864 |
| CAAGCTGGCCGCCTTCCCCG | 960 | CAAGCUGGCCGCCUUCCCCG | 1152 | PD1 EXON2_T31 | 35.3 | 0.945 |
| CTCAGCTCACCCCTGCCCCG | 961 | CUCAGCUCACCCCUGCCCCG | 1153 | PD1 EXON2_T77 | 34.7 | 0.89 |
| ATGTGGAAGTCACGCCCGTT | 962 | AUGUGGAAGUCACGCCCGUU | 1154 | PD1 EXON2_T1 | 34.6 | 0.935 |
| GAGATGGAGAGAGGTGAGGA | 963 | GAGAUGGAGAGAGGUGAGGA | 1155 | PD1 EXON2_T89 | 34.4 | 0.885 |
| GAAGGTGGCGTTGTCCCCTT | 964 | GAAGGUGGCGUUGUCCCCUU | 1156 | PD1 EXON2_T15 | 32.4 | 0.976 |

TABLE 8-continued

PD1 target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| TGACACGGAAGCGGCAGTCC | 965 | UGACACGGAAGCGGCAGUCC | 1157 | PD1 EXON2_T18 | 32.4 | 0.876 |
| ACCCTGGTGGTTGGTGTCGT | 966 | ACCCUGGUGGUUGGUGUCGU | 1158 | PD1 EXON3_T7 | 31.3 | 0.465 |
| CTTCCACATGAGCGTGGTCA | 967 | CUUCCACAUGAGCGUGGUCA | 1159 | PD1 EXON2_T21 | 31.1 | 0.962 |
| CCCTGCTCGTGGTGACCGAA | 968 | CCCUGCUCGUGGUGACCGAA | 1160 | PD1 EXON2_T5 | 30.5 | 0.965 |
| AGATGGAGAGAGGTGAGGAA | 969 | AGAUGGAGAGAGGUGAGGAA | 1161 | PD1 EXON2_T98 | 29.9 | 0.896 |
| TCCTGGCCGTCATCTGCTCC | 970 | UCCUGGCCGUCAUCUGCUCC | 1162 | PD1 EXON3_T22 | 29.9 | 0.802 |
| GGACCCAGACTAGCAGCACC | 971 | GGACCCAGACUAGCAGCACC | 1163 | PD1 EXON3_T26 | 29.8 | 0.819 |
| TGACGTTACCTCGTGCGGCC | 972 | UGACGUUACCUCGUGCGGCC | 1164 | PD1 EXON3_T2 | 29 | 0.822 |
| CTGAGAGATGGAGAGAGGTG | 973 | CUGAGAGAUGGAGAGAGGUG | 1165 | PD1 EXON2_T81 | 27.8 | 0.89 |
| GATGGAGAGAGGTGAGGAAG | 974 | GAUGGAGAGAGGUGAGGAAG | 1166 | PD1 EXON2_T82 | 27.2 | 0.956 |
| CACCAGGGTTTGAACTGGC | 975 | CACCAGGGUUUGGAACUGGC | 1167 | PD1 EXON3_T24 | 25.9 | 0.896 |
| GCAGGGCTGGGAGAAGGTG | 976 | GCAGGGCUGGGAGAAGGUG | 1168 | PD1 EXON2_T96 | 25.2 | 0.966 |
| GGCTCAGCTCACCCCTGCCC | 977 | GGCUCAGCUCACCCCUGCCC | 1169 | PD1 EXON2_T106 | 24.8 | 0.955 |
| AACTGGGCTGGCGGCCAGGATGG | 978 | CACCUACCUAAGAACCAUCC | 1170 | PD1 EXON1_T34 | 23.9 | 0.969 |
| AGCAGGGCTGGGGAGAAGGT | 979 | AGCAGGGCUGGGGAGAAGGU | 1171 | PD1 EXON2_T85 | 23.8 | 0.807 |
| ACATGAGCGTGGTCAGGGCC | 980 | ACAUGAGCGUGGUCAGGGCC | 1172 | PD1 EXON2_T41 | 23.7 | 0.984 |
| TCGGTCACCACGAGCAGGGC | 981 | UCGGUCACCACGAGCAGGGC | 1173 | PD1 EXON2_T28 | 23.5 | 0.954 |
| GGGCCCTGACCACGCTCATG | 982 | GGGCCCUGACCACGCUCAUG | 1174 | PD1 EXON2_T22 | 23.3 | 0.976 |
| CGTCTGGGCGGTGCTACAACTGG | 983 | CACCGCCCAGACGACUGGCC | 1175 | PD1 EXON1_T2 | 23.2 | 0.967 |
| CTGGCTGCGGTCCTCGGGA | 984 | CUGGCUGCGGUCCUCGGGA | 1176 | PD1 EXON2_T39 | 22.8 | 0.963 |
| TTTGTGCCCTTCCAGAGAGA | 985 | UUUGUGCCCUUCCAGAGAGA | 1177 | PD1 EXON3_T38 | 22.4 | 0.87 |
| AGGATGGTTCTTAGGTAGGTGGG | 986 | CGCCUGAGCAGUGGAGAAGG | 1178 | PD1 EXON1_T16 | 22.2 | 0.968 |
| GGTGCTGCTAGTCTGGGTCC | 987 | GGUGCUGCUAGUCUGGGUCC | 1179 | PD1 EXON3_T16 | 22.1 | 0.937 |
| GGCACTTCTGCCCTTCTCTC | 988 | GGCACUUCUGCCCUUCUCUC | 1180 | PD1 EXON3_T37 | 21.6 | 0.926 |

TABLE 8-continued

PD1 target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| ACAAAGGTCAGGGGTTAGGA | 989 | ACAAAGGUCAGGGGUUAGGA | 1181 | PD1 EXON3_T40 | 20.9 | 0.895 |
| TTCTGCCCTTCTCTCTGGAA | 990 | UUCUGCCCUUCUCUCUGGAA | 1182 | PD1 EXON3_T42 | 20.5 | 0.951 |
| CATGTGGAAGTCACGCCCGT | 991 | CAUGUGGAAGUCACGCCCGU | 1183 | PD1 EXON2_T2 | 20.3 | 0.979 |
| GTGCGGCCTCGGAGGCCCCG | 992 | GUGCGGCCUCGGAGGCCCCG | 1184 | PD1 EXON2_T40 | 20.2 | 0.99 |
| GATCTGCGCCTTGGGGGCCA | 993 | GAUCUGCGCCUUGGGGGCCA | 1185 | PD1 EXON2_T49 | 20 | 0.977 |
| GGGCGGTGCTACAACTGGGCTGG | 994 | CACUCUGGUGGGGCUGCUCC | 1186 | PD1 EXON1_T8 | 18.4 | 0.981 |
| GAGGTGAGGAAGGGGCTGGG | 995 | GAGGUGAGGAAGGGGCUGGG | 1187 | PD1 EXON2_T105 | 18.2 | 0.963 |
| ACGGAAGCGGCAGTCCTGGC | 996 | ACGGAAGCGGCAGUCCUGGC | 1188 | PD1 EXON2_T35 | 18.1 | 0.986 |
| CTGGAAGGGCACAAAGGTCA | 997 | CUGGAAGGGCACAAAGGUCA | 1189 | PD1 EXON3_T32 | 18.1 | 0.963 |
| GAGGGGCTGGGGTGGGCTGT | 998 | GAGGGGCUGGGGUGGGCUGU | 1190 | PD1 EXON3_T44 | 17.5 | 0.94 |
| ACTTCCACATGAGCGTGGTC | 999 | ACUUCCACAUGAGCGUGGUC | 1191 | PD1 EXON2_T10 | 17.4 | 0.984 |
| GGTCACCACGAGCAGGGCTG | 1000 | GGUCACCACGAGCAGGGCUG | 1192 | PD1 EXON2_T55 | 17.4 | 0.989 |
| CGCCTTGGGGGCCAGGGAGA | 1001 | CGCCUUGGGGGCCAGGGAGA | 1193 | PD1 EXON2_T103 | 17.2 | 0.933 |
| AGCCGGCCAGTTCCAAACCC | 1002 | AGCCGGCCAGUUCCAAACCC | 1194 | PD1 EXON3_T12 | 17.1 | 0.972 |
| TGCGGCCCGGGAGCAGATGA | 1003 | UGCGGCCCGGGAGCAGAUGA | 1195 | PD1 EXON3_T23 | 16.6 | 0.954 |
| CCCGAGGACCGCAGCCAGCC | 1004 | CCCGAGGACCGCAGCCAGCC | 1196 | PD1 EXON2_T63 | 16.1 | 0.96 |
| GTAACGTCATCCCAGCCCCT | 1005 | GUAACGUCAUCCCAGCCCCU | 1197 | PD1 EXON3_T25 | 15.6 | 0.957 |
| GGTGTCGTGGGCGGCCTGCT | 1006 | GGUGUCGUGGGCGGCCUGCU | 1198 | PD1 EXON3_T14 | 15.3 | 0.982 |
| ATCTCTCAGACTCCCCAGAC | 1007 | AUCUCUCAGACUCCCCAGAC | 1199 | PD1 EXON2_T48 | 14.4 | 0.988 |
| GGTAGGTGGGGTCGGCGGTCAGG | 1008 | GGAUGGUUCUUAGGUAGGUG | 1200 | PD1 EXON1_T12 | 13.7 | 0.973 |
| AGGTGCCGCTGTCATTGCGC | 1009 | AGGUGCCGCUGUCAUUGCGC | 1201 | PD1 EXON2_T11 | 13.5 | 0.982 |
| TGGGATGACGTTACCTCGTG | 1010 | UGGGAUGACGUUACCUCGUG | 1202 | PD1 EXON3_T1 | 13.2 | 0.964 |
| TCACCCTGAGCTCTGCCCGC | 1011 | UCACCCUGAGCUCUGCCCGC | 1203 | PD1 EXON2_T62 | 12.5 | 0.974 |
| CGGCCAGTTCCAAACCCTGG | 1012 | CGGCCAGUUCCAAACCCUGG | 1204 | PD1 EXON3_T20 | 12.1 | 0.97 |

TABLE 8-continued

PD1 target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| GCTCAGCTCACC CCTGCCCC | 1013 | GCUCAGCUCAC CCCUGCCCC | 1205 | PD1 EXON2_T90 | 12 | 0.148 |
| CGGGCAGAGCTC AGGGTGAC | 1014 | CGGGCAGAGCU CAGGGUGAC | 1206 | PD1 EXON2_T58 | 10.9 | 0.98 |
| GGTGCCGCTGTC ATTGCGCC | 1015 | GGUGCCGCUGU CAUUGCGCC | 1207 | PD1 EXON2_T12 | 10.7 | 0.987 |
| GCAGCCTGGTGC TGCTAGTC | 1016 | GCAGCCUGGUG CUGCUAGUC | 1208 | PD1 EXON3_T19 | 10.7 | 0.95 |
| TGGAACTGGCCG GCTGGCCT | 1017 | UGGAACUGGCC GGCUGGCCU | 1209 | PD1 EXON3_T27 | 10.6 | 0.974 |
| GAGCAGGGCTG GGGAGAAGG | 1018 | GAGCAGGGCUG GGGAGAAGG | 1210 | PD1 EXON2_T100 | 10.3 | 0.97 |
| CACGAGCAGGG CTGGGGAGA | 1019 | CACGAGCAGGG CUGGGGAGA | 1211 | PD1 EXON2_T95 | 10.2 | 0.977 |
| GGACCGCAGCC AGCCCGGCC | 1020 | GGACCGCAGCC AGCCCGGCC | 1212 | PD1 EXON2_T74 | 10 | 0.97 |
| CAGGGCTGGGG AGAAGGTGG | 1021 | CAGGGCUGGGG AGAAGGUGG | 1213 | PD1 EXON2_T97 | 10 | 0.956 |
| CCCCTTCGGTCA CCACGAGC | 1022 | CCCCUUCGGUC ACCACGAGC | 1214 | PD1 EXON2_T8 | 9.8 | 0.993 |
| ATCTGCTCCCGG GCCGCACG | 1023 | AUCUGCUCCCG GGCCGCACG | 1215 | PD1 EXON3_T5 | 9.8 | 0.982 |
| CTTCTGCCCTTC TCTCTGGA | 1024 | CUUCUGCCCUU CUCUCUGGA | 1216 | PD1 EXON3_T46 | 9.7 | 0.992 |
| AGCTTGTCCGTC TGGTTGCT | 1025 | AGCUUGUCCGU CUGGUUGCU | 1217 | PD1 EXON2_T19 | 9.6 | 0.995 |
| CCTCGGAGGCCC CGGGGCAG | 1026 | CCUCGGAGGCC CCGGGGCAG | 1218 | PD1 EXON2_T76 | 9.3 | 0.933 |
| AGGCGGCCAGCT TGTCCGTC | 1027 | AGGCGGCCAGC UUGUCCGUC | 1219 | PD1 EXON2_T9 | 9.1 | 0.991 |
| AGGGTTTGGAAC TGGCCGGC | 1028 | AGGGUUUGGA ACUGGCCGGC | 1220 | PD1 EXON3_T6 | 9.1 | 0.965 |
| AGAGCCTGCGG GCAGAGCTC | 1029 | AGAGCCUGCGG GCAGAGCUC | 1221 | PD1 EXON2_T59 | 8.8 | 0.984 |
| CAACCACCAGG GTTTGGAAC | 1030 | CAACCACCAGG GUUUGGAAC | 1222 | PD1 EXON3_T21 | 8.8 | 0.967 |
| TCTGGAAGGGCA CAAAGGTC | 1031 | UCUGGAAGGGC ACAAAGGUC | 1223 | PD1 EXON3_T28 | 8.8 | 0.984 |
| GGCCTCGGAGGC CCCGGGGC | 1032 | GGCCUCGGAGG CCCCGGGGC | 1224 | PD1 EXON2_T102 | 8.6 | 0.969 |
| AGAGCTCAGGGT GACAGGTG | 1033 | AGAGCUCAGGG UGACAGGUG | 1225 | PD1 EXON2_T93 | 8.4 | 0.087 |
| CGGTGCTACAAC TGGGCTGGCGG | 1034 | UCCAGGCAUGC AGAUCCCAC | 1226 | PD1 EXON1_T22 | 8.3 | 0.985 |
| CAGCCTGGTGCT GCTAGTCT | 1035 | CAGCCUGGUGC UGCUAGUCU | 1227 | PD1 EXON3_T29 | 8.2 | 0.977 |
| GGAGATGGCCCC ACAGAGGT | 1036 | GGAGAUGGCCC CACAGAGGU | 1228 | PD1 EXON2_T60 | 8.1 | 0.089 |

TABLE 8-continued

PD1 target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| AAAGGTCAGGGGTTAGGACG | 1037 | AAAGGUCAGGGGUUAGGACG | 1229 | PD1 EXON3_T18 | 8.1 | 0.987 |
| CAAAGGTCAGGGGTTAGGAC | 1038 | CAAAGGUCAGGGGUUAGGAC | 1230 | PD1 EXON3_T34 | 7.8 | 0.983 |
| CTGGTGGTTGGTGTCGTGGG | 1039 | CUGGUGGUUGGUGUCGUGGG | 1231 | PD1 EXON3_T30 | 7.7 | 0.984 |
| CCCGGGAGCAGATGACGGCC | 1040 | CCCGGGAGCAGAUGACGGCC | 1232 | PD1 EXON3_T10 | 7.5 | 0.986 |
| CGGAGAGCTTCGTGCTAAAC | 1041 | CGGAGAGCUUCGUGCUAAAC | 1233 | PD1 EXON2_T3 | 7.3 | 0.994 |
| CACGAAGCTCTCCGATGTGT | 1042 | CACGAAGCUCUCCGAUGUGU | 1234 | PD1 EXON2_T7 | 7 | 0.993 |
| CCCCTGCCCCGGGGCCTCCG | 1043 | CCCCUGCCCCGGGGCCUCCG | 1235 | PD1 EXON2_T83 | 7 | 0.992 |
| GGGCTGGGGAGAAGGTGGGG | 1044 | GGGCUGGGGAGAAGGUGGGG | 1236 | PD1 EXON2_T101 | 6.7 | 0.974 |
| GAGAGAGGTGAGGAAGGGGC | 1045 | GAGAGAGGUGAGGAAGGGGC | 1237 | PD1 EXON2_T92 | 6.6 | 0.982 |
| GGGGGGTTCCAGGGCCTGTC | 1046 | GGGGGGUUCCAGGGCCUGUC | 1238 | PD1 EXON2_T68 | 6.5 | 0.963 |
| TGGTGTCGTGGGCGGCCTGC | 1047 | UGGUGUCGUGGGCGGCCUGC | 1239 | PD1 EXON3_T13 | 6.2 | 0.983 |
| AGGGCTGGGGAGAAGGTGGG | 1048 | AGGGCUGGGGAGAAGGUGGG | 1240 | PD1 EXON2_T91 | 5.5 | 0.992 |
| GGTGCGGCCTCGGAGGCCCC | 1049 | GGUGCGGCCUCGGAGGCCCC | 1241 | PD1 EXON2_T64 | 5.3 | 0.99 |
| AGCCCCTCACCCAGGCCAGC | 1050 | AGCCCCUCACCCAGGCCAGC | 1242 | PD1 EXON3_T41 | 5.3 | 0.99 |
| CTCAGGCGGAGGTGAGCGGAAG | 1051 | GGUUCUUAGGUAGGUGGGGUG | 1243 | PD1 EXON1_T39 | 5.2 | 0.99 |
| AGCGGCAGTCCTGGCCGGGC | 1052 | AGCGGCAGUCCUGGCCGGGC | 1244 | PD1 EXON2_T43 | 5.2 | 0.981 |
| GGGCACAAAGGTCAGGGGTT | 1053 | GGGCACAAAGGUCAGGGGUU | 1245 | PD1 EXON3_T35 | 5.2 | 0.99 |
| CAGCTTGTCCGTCTGGTTGC | 1054 | CAGCUUGUCCGUCUGGUUGC | 1246 | PD1 EXON2_T16 | 5.1 | 0.996 |
| CCTGGGTGAGGGGCTGGGGT | 1055 | CCUGGGUGAGGGGCUGGGGU | 1247 | PD1 EXON3_T45 | 4.8 | 0.995 |
| CGACACCAACCACCAGGGTT | 1056 | CGACACCAACCACCAGGGUU | 1248 | PD1 EXON3_T9 | 4.7 | 0.992 |
| CGGAAGCGGCAGTCCTGGCC | 1057 | CGGAAGCGGCAGUCCUGGCC | 1249 | PD1 EXON2_T46 | 4.4 | 0.995 |
| TTGGAACTGGCCGGCTGGCC | 1058 | UUGGAACUGGCCGGCUGGCC | 1250 | PD1 EXON3_T11 | 4.3 | 0.989 |
| GGAGAAGGTGGGGGGGTTCC | 1059 | GGAGAAGGUGGGGGGGUUCC | 1251 | PD1 EXON2_T80 | 4.2 | 0.989 |
| ACCGCCCAGACGACTGGCCAGGG | 1060 | CAGGAUGGUUCUUAGGUAGG | 1252 | PD1 EXON1_T5 | 4.1 | 0.984 |

TABLE 8-continued

PD1 target sequences, gRNA spacer sequences, and cutting efficiencies in HEK293T cells

| Target Sequence | SEQ ID NO: | gRNA Spacer Sequence | SEQ ID NO: | Guide Name | Indel % | $R^2$ |
|---|---|---|---|---|---|---|
| GAGAAGGTGGG GGGGTTCCA | 1061 | GAGAAGGUGG GGGGGUUCCA | 1253 | PD1 EXON2_T65 | 3.8 | 0.987 |
| CTGGCCGGCTGG CCTGGGTG | 1062 | CUGGCCGGCUG GCCUGGGUG | 1254 | PD1 EXON3_T43 | 3.5 | 0.991 |
| CTACAACTGGGC TGGCGGCCAGG | 1063 | UGCCGCCUUCU CCACUGCUC | 1255 | PD1 EXON1_T15 | 3.2 | 0.981 |
| TCTTAGGTAGGT GGGGTCGGCGG | 1064 | AACUGGGCUGG CGGCCAGGA | 1256 | PD1 EXON1_T31 | 3.1 | 0.98 |
| GGGGGTTCCAGG CCTGTCT | 1065 | GGGGGUUCCAG GGCCUGUCU | 1257 | PD1 EXON2_T75 | 3.1 | 0.993 |
| CACCGCCCAGAC GACTGGCCAGG | 1066 | UCAGGCGGAGG UGAGCGGAA | 1258 | PD1 EXON1_T6 | 2.9 | 0.979 |
| CTCTTTGATCTG CGCCTTGG | 1067 | CUCUUUGAUCU GCGCCUUGG | 1259 | PD1 EXON2_T32 | 2.5 | 0.979 |
| GCCGGGCTGGCT GCGGTCCT | 1068 | GCCGGGCUGGC UGCGGUCCU | 1260 | PD1 EXON2_T53 | 2.5 | 0.996 |
| AGGTGCGGCCTC GGAGGCCC | 1069 | AGGUGCGGCCU CGGAGGCCC | 1261 | PD1 EXON2_T61 | 2.2 | 0.989 |
| TGATCTGCGCCT TGGGGGCC | 1070 | UGAUCUGCGCC UUGGGGGCC | 1262 | PD1 EXON2_T45 | 2.1 | 0.997 |
| CAGACTCCCCAG ACAGGCCC | 1071 | CAGACUCCCCA GACAGGCCC | 1263 | PD1 EXON2_T104 | 2 | 0.992 |
| CAGCAACCAGA CGGACAAGC | 1072 | CAGCAACCAGA CGGACAAGC | 1264 | PD1 EXON2_T24 | 1.9 | 0.996 |
| TCTCTTTGATCT GCGCCTTG | 1073 | UCUCUUUGAUC UGCGCCUUG | 1265 | PD1 EXON2_T29 | 1.9 | 0.994 |
| TTGTGCCCTTCC AGAGAGAA | 1074 | UUGUGCCCUUC CAGAGAGAA | 1266 | PD1 EXON3_T39 | 1.9 | 0.993 |
| AGTCCTGGCCGG GCTGGCTG | 1075 | AGUCCUGGCCG GGCUGGCUG | 1267 | PD1 EXON2_T79 | 1.4 | 0.996 |
| AGAGAGGTGAG GAAGGGGCT | 1076 | AGAGAGGUGA GGAAGGGGCU | 1268 | PD1 EXON2_T87 | 1.2 | 0.993 |
| GCTCTCTTTGAT CTGCGCCT | 1077 | GCUCUCUUUGA UCUGCGCCU | 1269 | PD1 EXON2_T20 | 1 | 0.992 |
| CAGGGTGACAG GTGCGGCCT | 1078 | CAGGGUGACAG GUGCGGCCU | 1270 | PD1 EXON2_T47 | 0.8 | 0.993 |
| GCCTCGGAGGCC CCGGGGCA | 1079 | GCCUCGGAGGC CCCGGGGCA | 1271 | PD1 EXON2_T71 | 0.2 | 0.993 |
| CTCTCTTTGATC TGCGCCTT | 1080 | CUCUCUUUGAU CUGCGCCUU | 1272 | PD1 EXON2_T23 | 0.1 | 0.994 |
| GACGTTACCTCG TGCGGCCC | 1081 | GACGUUACCUC GUGCGGCCC | 1273 | PD1 EXON3_T3 | | |
| AACCCTGGTGGT TGGTGTCG | 1082 | AACCCUGGUGG UUGGUGUCG | 1274 | PD1 EXON3_T4 | | |

In some embodiments, a gRNA comprises the sequence of any one of SEQ ID NOs: 1083-1275 or comprises a sequence that targets the sequence of any one of SEQ ID NOs: 891-1082.

PD1 Screen in SpCas9/HEK293T Cells and T Cells

Five (5) PD1 gRNAs were selected for further analysis in HEK293T cells and T cells. Three out of the five guides performed better (higher indel percentage) than the positive control (PD1 control). Surprisingly, the guide producing the highest indel percentage (editing frequency) (Guide 2) did not produce the greatest level of PD1 protein expression knockdown (compared to Guides 3-5—see Table 9).

TABLE 9

PD1 gRNA spacer sequences

|  | gRNA sequence | SEQ ID NO: | Indel HEK | Indel T cell | PD1+ T cells |
|---|---|---|---|---|---|
| Cas9 only | — | — | — | — | 44.7% |
| PD1 control | CGCCCACGACACCAACCACC | 1108 | 56.0% | 70.7% | 19.0% |
| Guide 1 | UGUCUGGGGAGUCUGAGAGA | 1083 | 94.7% | 86.4% | 31.7% |
| Guide 2 | ACUGCUCAGGCGGAGGUGAG | 1084 | 84.4% | 99.5% | 44.4% |
| Guide 3 | CGCAGAUCAAAGAGAGCCUG | 1085 | 83.1% | 60.3% | 4.76% |
| Guide 4 | CUGCAGCUUCUCCAACACAU | 1086 | 82.4% | 92.7% | 0.24% |
| Guide 5 | GCCCUGGCCAGUCGUCUGGG | 1146 | 80.8% | 99.0% | 0.31% |

A homology-dependent assessment of the PD1 gRNAs of Table 9 showed that PD1 Guide 5 (comprising SEQ ID NO: 1276) had an indel frequency of 20% at an off-target site, while PD1 Guide 4 (SEQ ID NO: 1086) had an indel frequency of less than 2.0% at an off-target site. This data guided selection of PD1 Guide 4 for further analysis.

CTLA-4 Screen in T Cells

One (1) million T cells were electroporated with 1000 pmol gRNA and 200 pmol Cas9 protein. 48-72 hours post-EP, cells were stimulated with a PMA/ionomycin cocktail solution and simultaneously stained with CTLA4 antibody (1:100 dilution, Biolegend #349907). Four (4) hours post-stimulation, cells were collected for FACS analysis. Two different donors were used (Donor 46 and Donor 13). Protein expression was measured by flow cytometry. The results are shown in Table 10. Use of Guide 5 (with spacer SEQ ID NO: 1292) consistently resulted in the lowest protein expression (e.g., 8.6%). Use of Guide 2 (with spacer SEQ ID NO: 1290) and Guide 9 (with spacer SEQ ID NO: 1297) also resulted in low protein expression (11.9% and 12.2%, respectively).

TABLE 10

CTLA-4 target and gRNA spacer sequences

|  | Target Sequence | Spacer Sequence | PAM (NGG) | CCTop (Raw)* | Donor46 Indel (%) | Donor13 Indel (%) | Donor46 Protein (%) |
|---|---|---|---|---|---|---|---|
| CTLA-4 Control | TGCCCAGGT AGTATGGCG GT (SEQ ID NO: 1277) | UGCCCAGG UAGUAUGG CGGU (SEQ ID NO: 1288) | GGG | -157 | 85.6 | 73.1 | 9.08 |
| Guide 1 | ACACCGCTC CCATAAAGC | ACACCGCU CCCAUAAA | TGG | -662 | 93.5 | 91.1 | 57.6 |

TABLE 10-continued

CTLA-4 target and gRNA spacer sequences

| | Target Sequence | Spacer Sequence | PAM (NGG) | CCTop (Raw)* | Donor46 Indel (%) | Donor13 Indel (%) | Donor46 Protein (%) |
|---|---|---|---|---|---|---|---|
| | CA (SEQ ID NO: 1278) | GCCA (SEQ ID NO: 1289) | | | | | |
| Guide 2 | TGGCTTGCCTTGGATTTCAG (SEQ ID NO: 1279) | UGGCUUGCCUUGGAUUUCAG (SEQ ID NO: 1290) | CGG | -1537.8 | 89.4 | 85.6 | 11.9 |
| Guide 3 | GCACAAGGCTCAGCTGAACC (SEQ ID NO: 1280) | GCACAAGGCUCAGCUGAACC (SEQ ID NO: 1291) | TGG | -5276.6 | 90.8 | 81.7 | 17.3 |
| Guide 4 | TTCCATGCTAGCAATGCACG (SEQ ID NO: 1281) | UUCCAUGCUAGCAAUGCACG (SEQ ID NO: 1292) | TGG | -967.3 | 77.7 | 42.2 | 21.3 |
| Guide 5 | GCACGTGGCCCAGCCTGCTG (SEQ ID NO: 1282) | GCACGUGGCCCAGCCUGCUG (SEQ ID NO: 1293) | TGG | -2387.2 | 91.9 | 82.9 | 8.6 |
| Guide 6 | GTGGTACTGGCCAGCAGCCG (SEQ ID NO: 1283) | GUGGUACUGGCCAGCAGCCG (SEQ ID NO: 1294) | AGG | -1048.4 | 85.1 | 51.5 | 27.6 |
| Guide 7 | GTGTGTGAGTATGCATCTCC (SEQ ID NO: 1284) | GUGUGUGAGUAUGCAUCUCC (SEQ ID NO: 1295) | AGG | -1299.5 | 93.9 | 59.1 | 14.6 |
| Guide 8 | AGGACTGAGGGCCATGGACA (SEQ ID NO: 1285) | AGGACUGAGGGCCAUGGACA (SEQ ID NO: 1296) | CGG | -1624.6 | 76.1 | 64.4 | 12.2 |
| Guide 9 | TCCTTGCAGCAGTTAGTTCG (SEQ ID NO: 1286) | UCCUUGCAGCAGUUAGUUCG (SEQ ID NO: 1297) | GGG | -242.2 | 95.5 | 90.9 | 12.2 |
| Guide 10 | TCAGAATCTGGGCACGGTTC (SEQ ID NO: 1287) | UCAGAAUCUGGGCACGGUUC (SEQ ID NO: 1298) | TGG | -516.9 | 93.6 | 54.1 | 37.9 |

Example 2—Gene Knockout at Genotypic and Phenotypic Levels in Cells

This example demonstrates efficient knockout by CRISPR/Cas9 of Graft vs. Host (GVH) or Host vs. Graft (HVG) or Immune checkpoint genes at the genotypic and phenotypic levels in primary human T cells.

Primary human T cells were isolated from peripheral blood (AllCells, Alameda, Calif.) using EasySep Direct Human T Cell Isolation Kit (Stemcell Technologies, Vancouver, Canada). The cells were plated at $0.5 \times 10^6$ cells/mL in large flasks. Human T-Activator CD3/CD28 Dynabeads (Thermo Fisher Scientific, Waltham, Mass.) were resuspended and washed with PBS prior to adding to the cells. The cells were incubated with Human T-Activator CD3/CD28 Dynabeads (Thermo Fisher Scientific, Waltham, Mass.) at a bead-to-cell ratio of 1:1 in X-vivo 15 hematopoietic serum-free medium (Thermo Fisher Scientific, Waltham, Mass.) supplemented with 5% human serum (Sigma-Aldrich, St. Louis, Mo.), 50 ng/mL human recombinant IL-2 (Peprotech, Rocky Hill, N.J.), and 10 ng/mL human recombinant IL-7 (Thermo Fisher Scientific, Waltham, Mass.). After 3 days, the cells were transferred to a 15 mL tube and the beads were removed by placing the tube on a magnet for 5 mins. Cells were then transferred, pelleted and plated at $0.5 \times 10^6$ cells/mL.

Three (3) days after beads were removed, T cells were electroporated using the 4D-Nucleofector (program E0115) (Lonza, Walkersville, Md.) and Human T Cells Nucleofector Kit (Lonza, Walkersville, Md.). The nucleofection mix contained the Nucleofector Solution, $10^6$ cells, 1 µM Cas9 (Feldan, Québec, Canada), and 5 µM 2'-O-methyl 3' phosphorothioate (MS) modified sgRNA (TriLink BioTechonologies, San Diego, Calif.) (As described in Hendel et al., 2015: PMID: 26121415). The MS modification was incorporated at three nucleotides at both the 5' and 3' ends. To allow for stable Cas9:sgRNA ribonucleoproteins (RNPs) formation, Cas9 was pre-incubated with sgRNAs in a Cas9:sgRNA molar ratio of 1:5 at 37° C. for 10 min prior to adding the nucleofection mix. For multiplex editing experiments, 1 µM (final concentration) each of Cas9 pre-complexed individually with sgRNAs was added to the electroporation buffer mix. Typical controls for each experiment included: non-electroporated cells, one mock treatment without the RNPs, one treatment with Cas9 alone and one treatment with MS modified AAVS1 sgRNA to monitor transfection efficiency. Following nucleofection, the cells were incubated at 37° C. for 4-7 days and analyzed by flow cytometry for surface protein expression and Tracking of InDels by Decomposition (TIDE) for insertions or deletions (InDels) on genomic DNA.

TIDE is a web tool to rapidly assess genome editing by CRISPR/Cas9 of target locus determined by a guide RNA (gRNA or sgRNA). Based on quantitative sequence trace data from two standard capillary sequencing reactions, the TIDE software quantifies the editing efficacy and identifies the predominant types of insertions and deletions (InDels) in the DNA of a targeted cell pool.

This example and the following example tested sgRNAs delivered by RNP. The sgRNA sequence comprise a 20 nucleotide spacer sequence (indicated in each example) followed by a backbone sequence. Table 11 lists target sequences specific to the indicated gene that were used as sgRNAs in synthetic and modified form that when complexed with Cas9 protein produced the indicated InDel % in primary human T cells. Table 11 lists InDel frequencies for synthetic and/modified sgRNA sequences (delivered as RNPs) targeting the indicated genes and target sequences in primary human T cells.

Examples of backbone sequences are shown in Table 1.

TABLE 11

Indel frequencies

| SEQ ID NO: | Gene | Target Sequence | % InDel in T Cells (Synthetic Guides) |
|---|---|---|---|
| 76 | TRAC | AGAGCAACAGTGCTGTGGCC | 72 |
| 1299 | TRAC | GGCTCTCGGAGAATGACGAG | 61 |
| 962 | PD1 | ATGTGGAAGTCACGCCCGTT | 25 |
| 916 | PD1 | CGCCCACGACACCAACCACC | 53 |
| 1300 | PD1 | CGACTGGCCAGGGCGCCTGT | 48.4 |
| 1277 | CTLA4 | TGCCCAGGTAGTATGCGGT | 40 |
| 417 | B2M | GCTACTCTCTCTTTCTGGCC | 91 |
| 1301 | AAVS1 | GGGGCCACTAGGGACAGGAT | 75 |
| 1302 | AAVS1 | GCCAGTAGCCAGCCCCGTCC | 40 |
| 546 | CIITA | GGTCCATCTGGTCATAGAAG | 81 |
| 1303 | CD52 | TTACCTGTACCATAACCAGG | 83 |
| 1304 | CD52 | CCTACTCACCATCAGCCTCC | 87 |
| 226 | CD3E | GGGCACTCACTGGAGAGTTC | 67 |
| 222 | CD3E | TAAAAACATAGGCGGTGATG | 68 |
| 1305 | RFX5 | TACCTCGGAGCCTCTGAAGA | 88 |
| 1306 | RFX5 | TGTGCTCTTCCAGGTGGTTG | 87 |
| 1307 | RFX5 | ATCAAAGCTCGAAGGCTTGG | 70 |

Example 3—Editing TCR Components in Cells

Figure 6A:
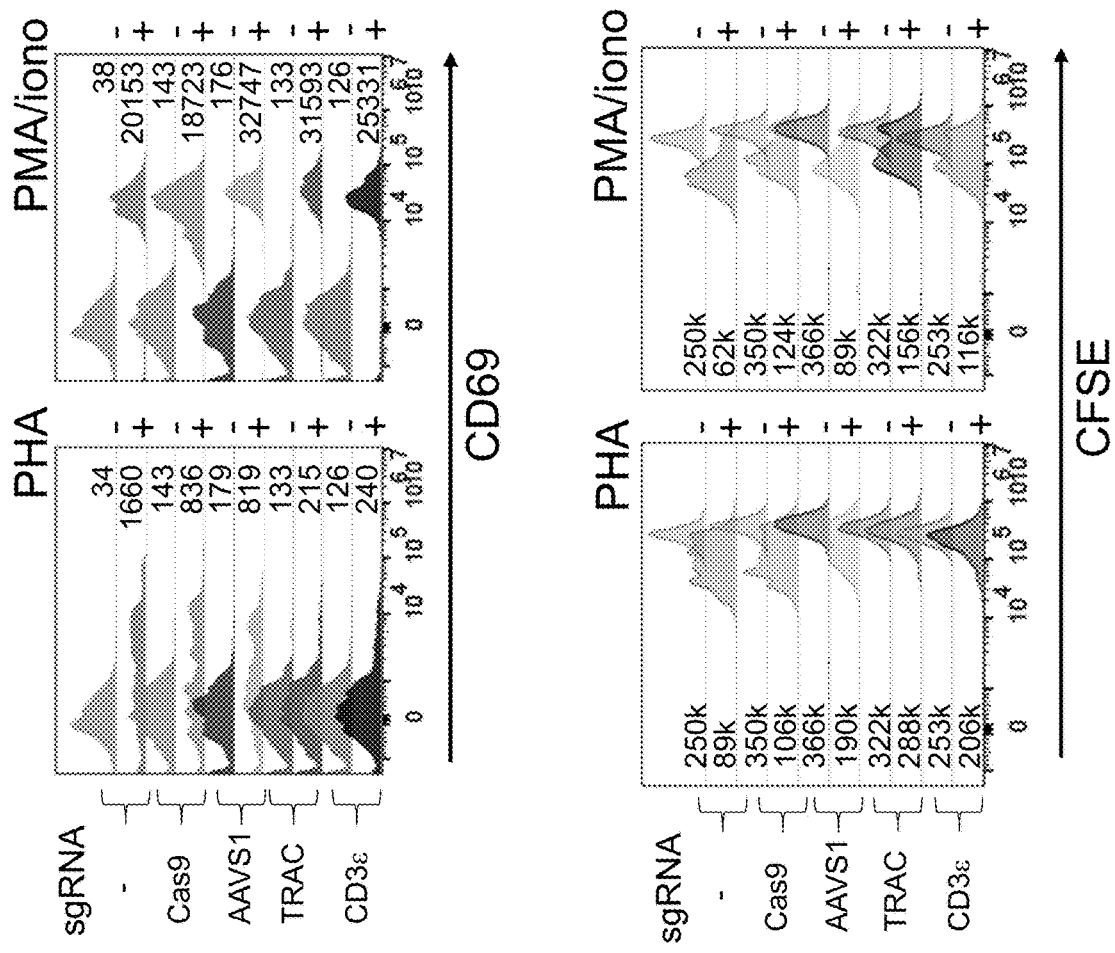
FIGS. 6A and 6B are a series of images of flow cytometry plots depicting lack of reactivity to PHA-L, but normal responses to PMA/ionomycin by TCRα or CD3ε null human T cells as compared to controls.
Figure 6B:
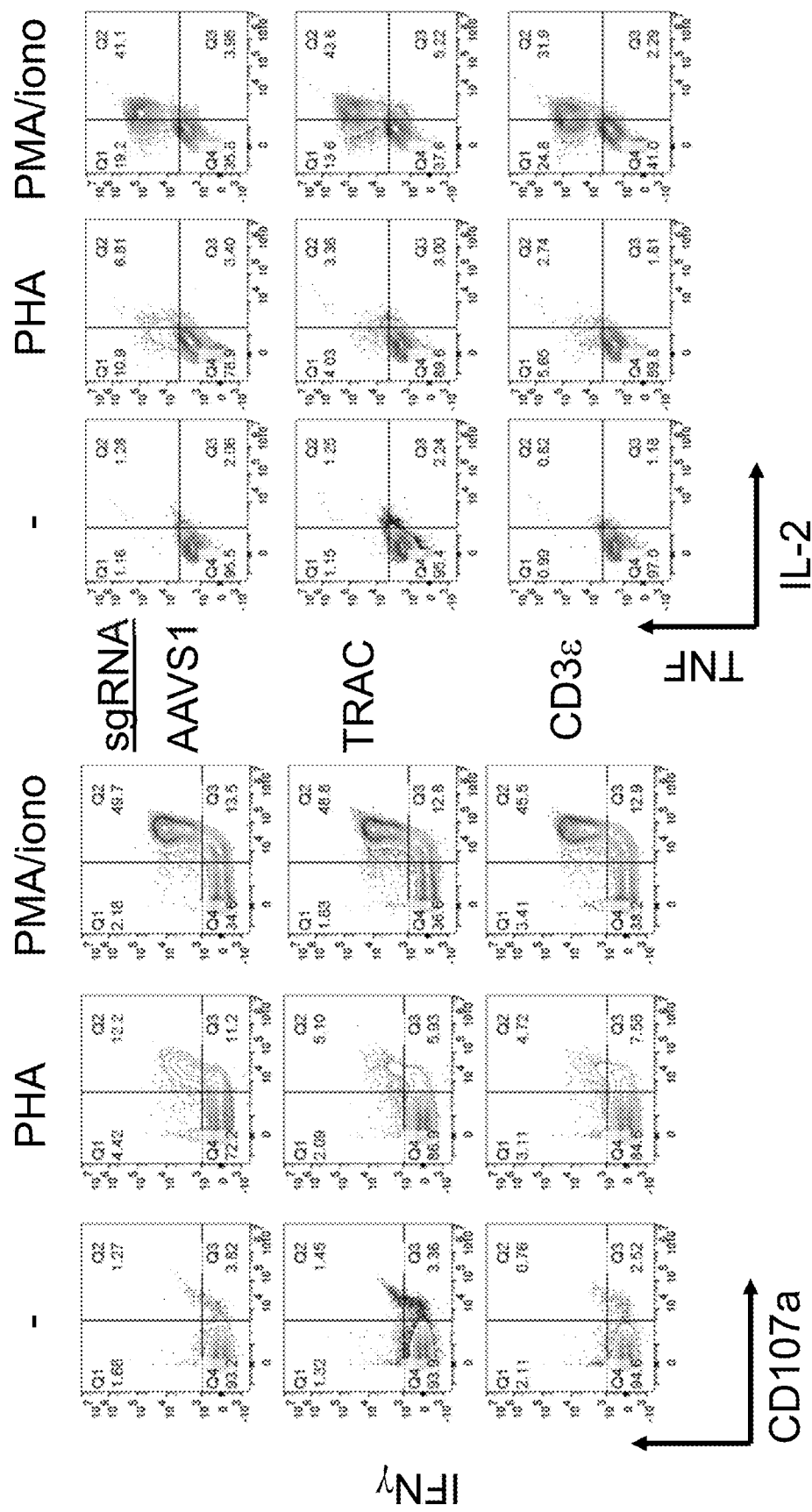

This example demonstrates the in vitro functional consequences in primary human T cells of editing TCR components (TCRa and CDR). The results of which are shown in FIGS. 6A and 6B.

For flow cytometry experiments, approximately $0.5 \times 10^6$ to $1 \times 10^6$ RNP transfected cells were removed from culture 4-6 days post electroporation and transferred to a clean Eppendorf tube. Cells were pelleted by centrifugation at 1,200 rpm for 5 min and resuspended in 100 µL FACS buffer (0.5% BSA/PBS). To stain the cells, appropriate antibody cocktail was added to the sample, followed by incubation for 10-15 min at room temperature. UltraComp eBeads (Ebioscience, San Diego, Calif.) were used for preparing compensation controls along with the specific conjugated antibody when necessary. The compensation beads were stained at 1:100 with individual specific primary antibody used in the experiment for about 5 min. Stained samples (including compensation controls) were washed with 1 mL FACS buffer, centrifuged at 1,200 rpm, and aspirated to remove the buffer. Compensation beads were resuspended in 200 µL FACS buffer and passed through a 5 mL FACS tube with a cell strainer cap (Corning Inc., Corning, N.Y.). Cell samples were resuspended in 200 µL FACS buffer containing 1:1000 7AAD (Thermo Fisher Scientific, Waltham, Mass.), and passed through a 5 mL FACS tube with a cell strainer cap. Samples were then examined on NovoCyte ACEA 3000 flow cytometer (ACEA Biosciences, San Diego, Calif.) using the automatic compensation software and data was analyzed on Flowjo10.1r5. Antibodies used include BV510 anti-human CD3 (UCHT1, BioLegend, San Diego, Calif.), PE anti-human TCRαβ (BW242/412, Miltenyi Biotec, Auburn, Calif.), PE/Cy7 anti-human CD8 (SK1, BioLegend, San Diego, Calif.), and APC/Cy7 anti-human CD4 (RPA-T4, BioLegend, San Diego, Calif.).

Without being bound by theory, the reason for disrupting TCR in therapeutic T cells was that these T cells would not signal through upstream stimuli to the TCR, and thus not react with recipient peptides/antigens, but would maintain their ability to respond to downstream TCR signaling even after TCR knock-out. Phytohemagglutanin (PHA) and phorbol myristate acetate (PMA)/Ionomycin are two commonly used stimulation regimens for in vitro T cell activation, but they act through distinct mechanisms. PHA is a mitogenic lectin that activates the cells by crosslinking the TCR/CD3 complex as well as other glycosylated membrane proteins. On the contrary, PMA/Ionomycin stimulates T cells by directly activating TCR downstream pathways, bypassing the need for surface receptor stimulation. Therefore, TCR/CD3 deficient T cells were expected to react to PMA/Ionomycin but not to PHA.

To assess the function of TCR ablated T cells, primary human T cells were edited with CRISPR/Cas9 to disrupt TCR components TCRα or CD3ε, treated with the two stimulation regimens, and tested for activation, proliferation, degranulation, and cytokine production using a series of assays described below. Primary human T cells were first electroporated with Cas9 or Cas9:sgRNA RNP complexes targeting AAVS1 (GGGGCCACTAGGGACAGGAT (SEQ ID NO: 1301)), TRAC (AGAGCAACAGTGCTGTGGCC (SEQ ID NO: 76)), or CD3ε (GGGCACTCACTGGAGAGTTC (SEQ ID NO: 226)). Six (6) days post transfection, cells were stained for CD3ε and the percentage of cells with low or absent levels of CD3ε were assessed by flow cytometry. The results showed that transfection with Cas9:TRAC sgRNA or Cas9:CD3ε sgRNA largely reduced surface presentation of CD3. The CD3⁻ population in Cas9: TRAC sgRNA and Cas9:CD3ε sgRNA transfected cells was 89% and 81%, respectively, whereas the percentage were 10% and 5% in Cas9 only or Cas9:AAVS1 sgRNA transfected cells. This confirmed that the CRISPR/Cas9 edited cells had deficient TCR/CD3 complexes. These cells served as inputs for the assessment in the subsequent assay experiments. The gRNAs used in this Example comprise the following spacer sequences:

```
AAVS1 gRNA spacer
(GGGGCCACUAGGGACAGGAU (SEQ ID NO: 1308)),

TRAC gRNA spacer
(AGAGCAACAGUGCUGUGGCC (SEQ ID NO: 152)),
and

CD3ε gRNA spacer
(GGGCACUCACUGGAGAGUUC (SEQ ID NO: 351)).
```

CD69 Activation Assay

CD69 is a surrogate marker of T-cell responsiveness to mitogen and antigen stimulus and is used as a measure of T-cell activation. 7 days post transfection, cells were stimulated with either PHA-L (Ebioscience, San Diego, Calif.) or PMA/Ionomycin and grown for additional 2 days. Cells were then stained with APC mouse anti-human CD69 antibody (L78, BD Biosciences, San Jose, Calif.) and the levels of CD69 were assayed by flow cytometry (FIG. 6A). Control cells that received neither PHA nor PMA/Ionomycin treatment had little CD69 expression, suggesting there was no T-cell activation. Cells with intact TCR/CD3 complexes (Mock transfectedH, Cas9 alone, and Cas9:AAVS1 sgRNA transfected groups) displayed induced expression of CD69 after either PHA or PMA/Ionomycin treatment albeit to varying degrees. In contrast, neither cells treated with Cas9: TRAC (targeting AGAGCAACAGTGCTGTGGCC (SEQ ID NO: 76)), nor cells treated with Cas9: CD3ε (targeting GGGCACTCACTGGAGAGTTC (SEQ ID NO: 226)), showed induced CD69 expression after PHA treatment, indicating that the TCR/CD3ε complex was disrupted within these cells. However, both treatment groups exhibited strong expression of CD69 after PMA/Ionomycin treatment (FIG. 6A). This demonstrated that the TCR/CD3 deficient T cells show blunted responses to TCR agonists, but retained ability to be activated with signals downstream of the TCR.

CFSE Proliferation Assay

To further examine cell proliferation in TCR/CD3 deficient cells, the response to PHA and PMA/Ionomycin in the TCR/CD3 deficient cells was assessed. Carboxyfluorescein succinimidyl ester (CFSE) is a cell-permeant fluorescein-based dye used for monitoring lymphocyte proliferation. After transfection, the cells were labeled with 500 nM CFSE for 15 min at 37° C. After washing, cells were plated in serum and cytokine free media for 4 days. CFSE levels were measured by flow cytometry in the FITC channel (FIG. 6A). Control cells that received neither PHA nor PMA/Ionomycin treatment showed CFSE intensity expected of non-divided cells. Both PHA and PMA/Ionomycin treatment caused a shift in CFSE intensity in Mock transfected cells (Cas9 alone) and Cas9:AAVS1 sgRNA transfected groups, indicating cell proliferation is stimulated in cells with cell surface TCR and CD3. As expected, Cas9:TRAC sgRNA (targeting AGAGCAACAGTGCTGTGGCC (SEQ ID NO: 76)), and Cas9:CD3ε sgRNA (targeting GGGCACT-CACTGGAGAGTTC (SEQ ID NO: 226)) transfected cells did not exhibit cell proliferation after PHA treatment, but exhibited strong proliferation after PMA/Ionomycin treatment. This result was consistent with our previous observation, Cas9:TRAC sgRNA and Cas9:CD3ε sgRNA treatment disrupts cell signaling through the TCR/CD3 complex.

Flow Cytometry Evaluation of CD107a and Intracellular Cytokines

Two other T cell activation events, degranulation and cytokine production, were also examined using flow cytometry. The transfected cells were either untreated, PHA or PMA treated in serum and cytokine free media. Concurrently, cells were incubated with Golgi Plug (BD Biosciences, San Jose, Calif.), Golgi Stop (BD Biosciences, San Jose, Calif.) and PE-Cy7 anti-human CD107a antibody (H4A3, Biolegend, San Diego, Calif.). Four (4) hours post treatment, cells were surface stained with the following antibodies anti-human CD3 (UCHT1, BioLegend, San Diego, Calif.), PE/Cy7 anti-human CD8 (SK1, BioLegend, San Diego, Calif.), and APC/Cy7 anti-human CD4 (RPA-T4, BioLegend, San Diego, Calif.) and fixed and permeabilized using BD Cytofix/Cytoperm Plus kit (BD Biosciences, San Jose, Calif.). Finally, cells were stained for intracellular cytokines with FITC anti-human TNFα antibody (Mab11, Biolegend, San Diego, Calif.), APC mouse anti-human IFNγ antibody (25723.11, BD Biosciences, San Jose, Calif.), and PE rat anti-human IL-2 antibody (MQ1-17H12, BD Biosciences, San Jose, Calif.), washed, and analyzed by flow cytometry.

Surface expressed CD107a is a marker for CD8+ T cell degranulation following stimulation. Control cells that had received neither PHA nor PMA/Ionomycin treatment showed minimal surface expression of CD107. Both PHA and PMA/Ionomycin treatments induced CD107a expression in mock transfected, Cas9 alone, and Cas9:AAVS1 sgRNA transfected groups. Again, TCRa or CD3ε deficient cells showed base levels of CD107a expression after PHA treatment but largely increased levels of CD107a expression after PMA/Ionomycin treatment (FIG. 6B). This demonstrated that PMA/Ionomycin, but not PHA, was able to induce degranulation in TCR/CD3 deficient cells.

Similarly, enhanced levels of intracellular cytokine TNF, IFNγ, and IL-2 were observed after either PHA or PMA/Ionomycin treatment in the mock transfected, Cas9 alone, and Cas9:AAVS1 sgRNA transfected cells (FIG. 6B).

Taken together, these experiments demonstrated that the TCR/CD3 complex is disrupted in the gene edited cells with signaling downstream of the TCR remaining intact in TCR/CD3 deficient cells, as indicated by cell proliferation, degranulation and effector cytokine production.

Example 4—Editing MHC II Components in Cells

This example demonstrates the in vitro functional consequences in primary human T cells of editing MHC II components (CIITA or RFX5). The results are shown in FIG. 7.

Primary human T cells were transfected with RNP containing synthetic sgRNAs targeting AAVS1 (GGGGC-CACTAGGGACAGGAT (SEQ ID NO: 1301)), B2M (GC-TACTCTCTCTTTCTGGCC (SEQ ID NO: 417)), CIITA (GGTCCATCTGGTCATAGAAG (SEQ ID NO: 546)), RFX5-1 (TACCTCGGAGCCTCTGAAGA (SEQ ID NO: 1305)), RFX5-5 (TGTGCTCTTCCAGGTGGTTG (SEQ ID NO: 1306)), and RFX5-10 (ATCAAAGCTCGAAGGCT-TGG (SEQ ID NO: 1307)). 4-6 days post transfection cells were treated with PMA/ionomycin overnight and surface levels of MHC-II were assessed by flow cytometry (Tu39, PE-Cy7 conjugate, Biolegend). The amount of MHC-II induction (assessed by median fluorescence intensity [MFI])

per test sample was normalized to the amount of MHC-II present on control (AAVS1) transfected cells (FIG. 7). The percentage of MHC-II+ cells remaining post transfection and PMA/ionomycin induction is indicated in the left panel. Data are from 4 or 3 biological donors for single or dual sgRNA(s) transfected cells, respectively. Statistical significance was assessed using ANOVA with Tukey post hoc correction.

In addition, RNPs containing Cas9 and sgRNAs targeting CIITA or RFX5 diminish surface levels of MHC-II in induced primary human T cells.

The gRNAs used in this Example comprise the following spacer sequences: AAVS1 gRNA spacer (GGGGCCAC-UAGGGACAGGAU (SEQ ID NO: 1308)); B2M gRNA spacer (GCUACUCUCUCUUUCUGGCC (SEQ ID NO: 466)); CIITA gRNA spacer (GGUCCAUCUGGUCAUA-GAAG (SEQ ID NO: 738)), RFX5-1 gRNA spacer (UAC-CUCGGAGCCUCUGAAGA (SEQ ID NO: 1309)), RFX5-5 gRNA spacer (UGUGCUCUUCCAGGUGGUUG (SEQ ID NO: 1310)), and RFX5-10 gRNA spacer (AU-CAAAGCUCGAAGGCUUGG (SEQ ID NO: 1311)).

Example 5—Editing Immune Checkpoint Components in Cells

Primary human T cells were transfected with RNP containing synthetic sgRNAs targeting PD-1 (CGCCCACGA-CACCAACCACC (SEQ ID NO: 916) and comprising the spacer sequence of SEQ ID NO: 1108) or control. 4-6 days post transfection cells were treated with PMA/ionomycin, and surface levels of PD-1 were assessed by flow cytometry (EH12.2H7, BV421 conjugate, Biolegend). The amount of PD1 induction (assessed by median fluorescent intensity [MFI]) per test sample was normalized to the amount of PD1 present in untreated control transfected cells. Data are from 3 biological donors for single or dual sgRNA(s) transfected cells, respectively. Statistical significance was assessed using Student's t test.

In addition, RNPs containing Cas9 and sgRNAs targeting PD1 diminish surface levels of PD1 in induced primary human T cells.

Example 6—Multiplex Editing in Cells

Figure 8:
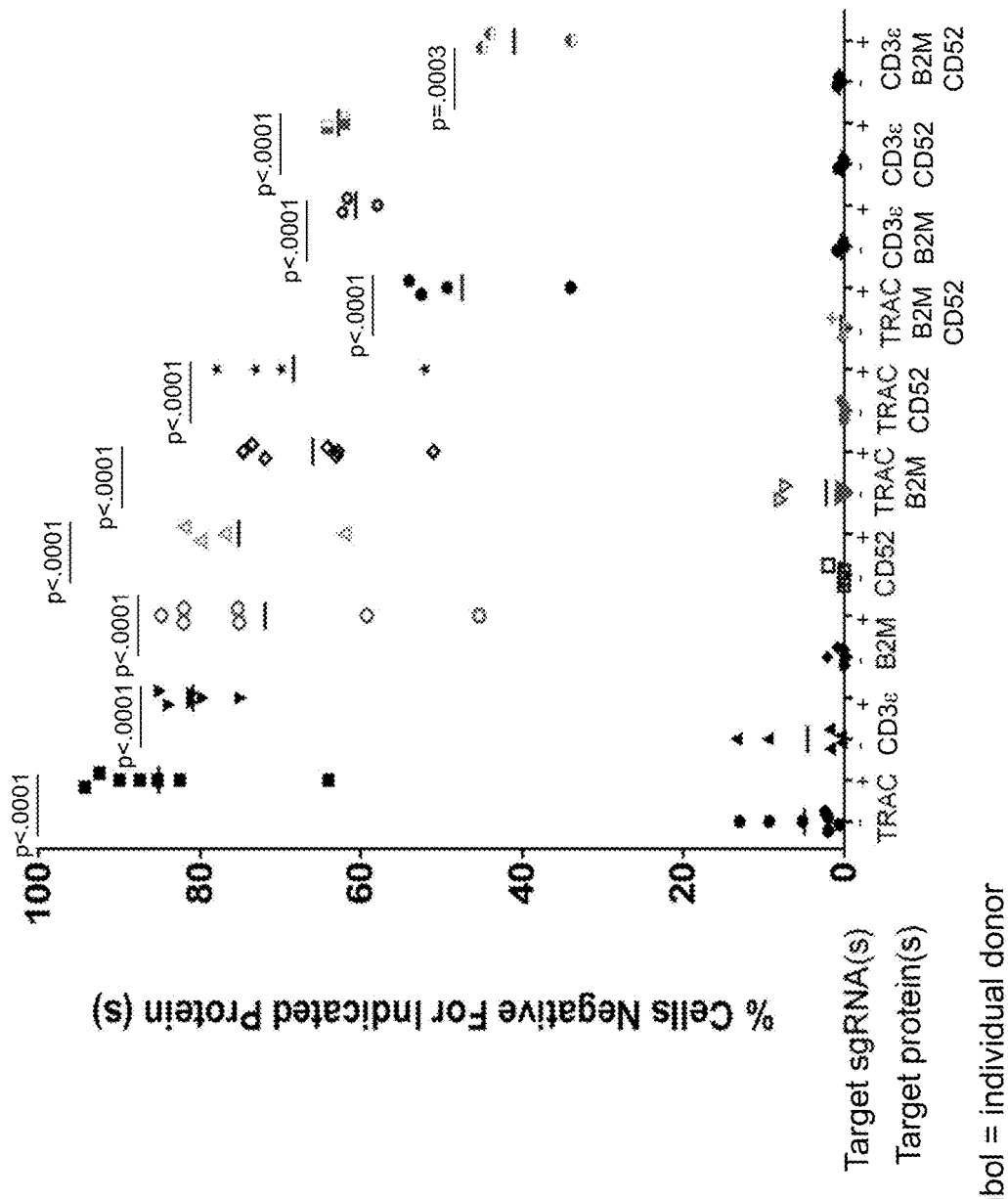
FIG. 8 is a graph depicting levels of surface protein loss as measured by flow cytometry after treatment of primary human T cells with RNPs targeting either 1, 2 or 3 genes alone or simultaneously (multiplex editing).
Figure 9:
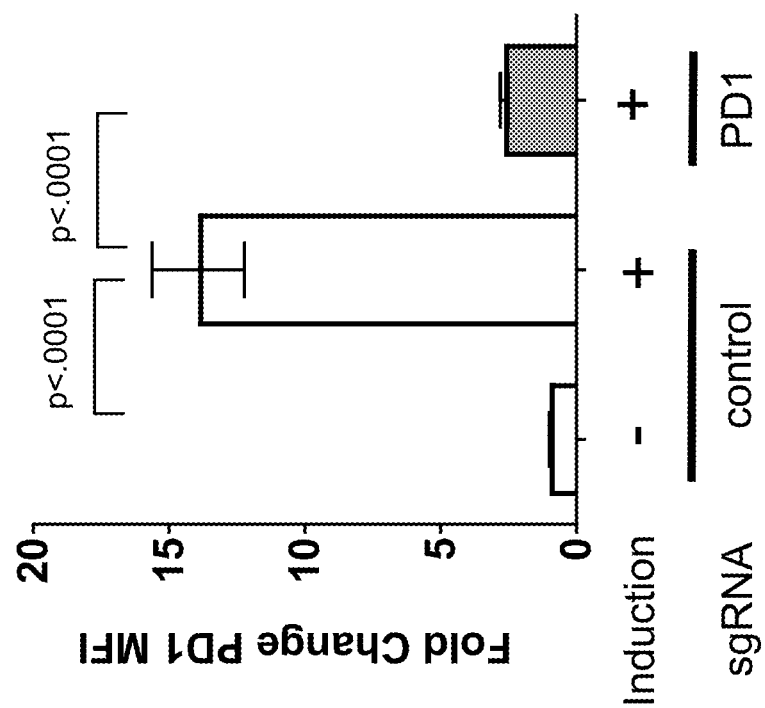
FIG. 9 is a graph depicting surface levels of PD1 by flow cytometry after PMA/ionomycin treatment in control and RNP (containing PD1 sgRNA) containing primary human T cells.

This example demonstrates efficient multiplex editing and target protein knock out in primary human T cells. The results are shown in FIG. 8.

Primary human T cells were transfected with RNP containing synthetic sgRNAs targeting the indicated genes. For the knockout of 2 or more genes and their protein products in the same cell (multiplex editing), 1 μM (final concentration) each of Cas9 pre-complexed individually with sgRNAs was added to the nucleofection mix. Surface levels of the indicated proteins were measured by flow cytometry 4-6 days after transfection. Antibodies used include BV510 anti-human CD3 (UCHT1, BioLegend, San Diego, Calif.), PE anti-human TCRαβ (BW242/412, Miltenyi Biotec, Auburn, Calif.), APC anti-human B2M (2M2, Biolegend), FITC anti-human CD52 (097, Biolegend). Each symbol is data from an individual biological donor where test RNP treated cells are compared to control RNP treated cells. Statistical significance was assessed by Student's t test.

Guides used in this example are listed below with the respective target and spacer sequences:

```
TRAC
                                      (SEQ ID NO: 76)
     AGAGCAACAGTGCTGTGGCC;

(SEQ ID NO: 152)
     AGAGCAACAGUGCUGUGGCC

B2M
                                      (SEQ ID NO: 417)
     GCTACTCTCTCTTTCTGGCC;

(SEQ ID NO: 466)
     GCUACUCUCUCUUUCUGGCC

CD3ε
                                      (SEQ ID NO: 226)
     GGGCACTCACTGGAGAGTTC;

(SEQ ID NO: 351)
     GGGCACUCACUGGAGAGUUC;

CD52
                                      (SEQ ID NO: 1303)
     TTACCTGTACCATAACCAGG (SEQ ID NO: 1312)
     UUACCUGUACCAUAACCAGG

CIITA
                                      (SEQ ID NO: 546)
     GGTCCATCTGGTCATAGAAG (SEQ ID NO: 738)
     GGUCCAUCUGGUCAUAGAAG

AAVS1
                                      (SEQ ID NO: 1301)
     GGGGCCACTAGGGACAGGAT (SEQ ID NO: 1308)
     GGGGCCACUAGGGACAGGAU
```

In order to assess the feasibility of triple knockout using CRISPR/Cas9, primary T cells (5×10⁶) were transfected with pre-formed RNPs targeting three separate genes: TRAC, B2M, and CIITA. RNP containing sgRNAs targeting AAVS1 served as a negative control. After 4 days, cells were split into two halves: one half was treated with anti-CD3/anti-B2M biotin antibodies and subsequently purified using Streptavidin Microbeads (Miltenyi Biotec, Cambridge, Mass.), and the other half remained untreated. Purified (pur) and unpurified (un) cells were both analyzed by TIDE. TIDE analysis showed that this approach produced a triple knockout InDel frequency of ~36% compared to the control group, proving, at the DNA level, that it is possible to knockout three genes simultaneously using Cas9:sgRNA RNPs in a single experiment (FIG. 15).

Figure 15:
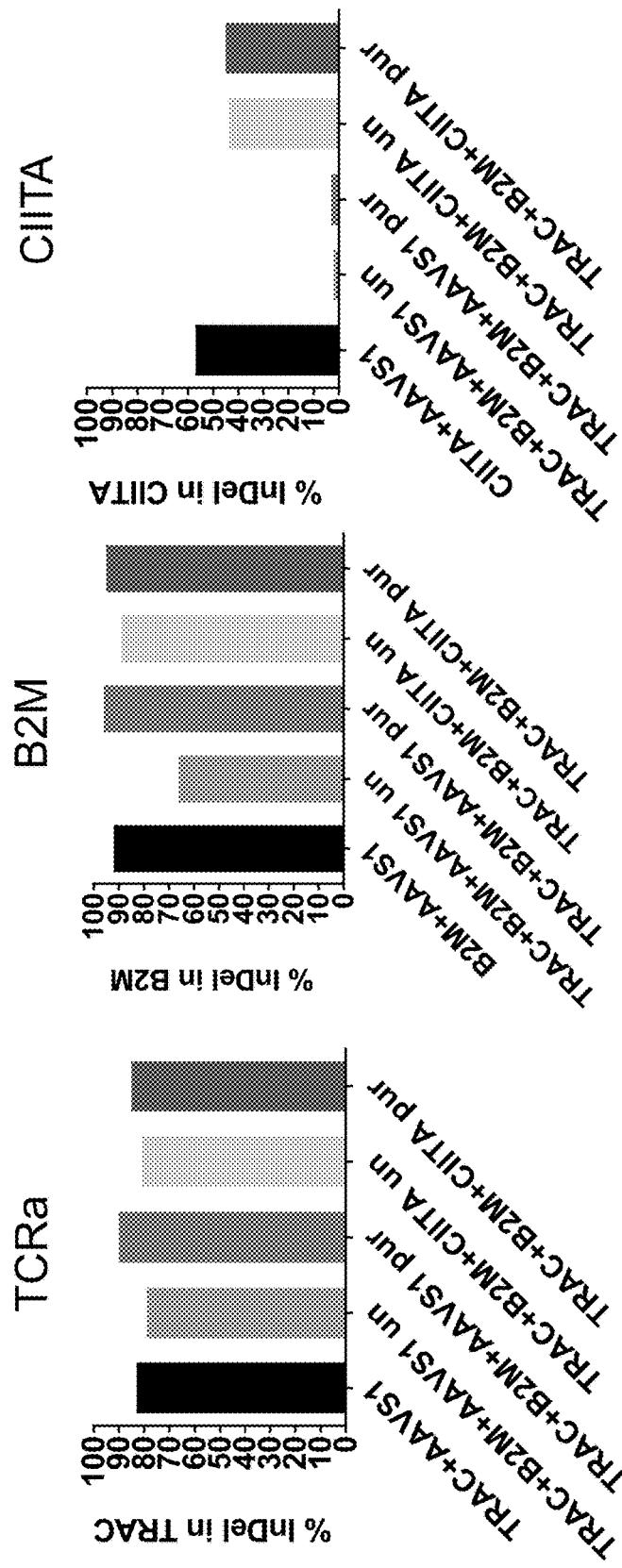
FIG. 15 is a graph depicting TIDE analysis on DNA from Cas9:sgRNA RNP treated human T cells to demonstrate concurrent triple knockout of the TCR, B2M and CIITA. The RNP treatments included combinations of TCRα (TRAC), B2M and/or CIITA.

In addition, the data in FIG. 15 demonstrates that efficient single, double, and triple gene knockout can be obtained in primary human T cells transfected with Cas9:synthetic sgRNA (RNPs).

Example 7—HDR-Mediated Transgene Insertion in Cells

This example demonstrates efficient transgene insertion in primary human T cells via homology directed repair (HDR) by Cas9:sgRNA RNP-mediated double-stranded genomic DNA breaks with an AAV6 donor DNA template.

Figure 10:
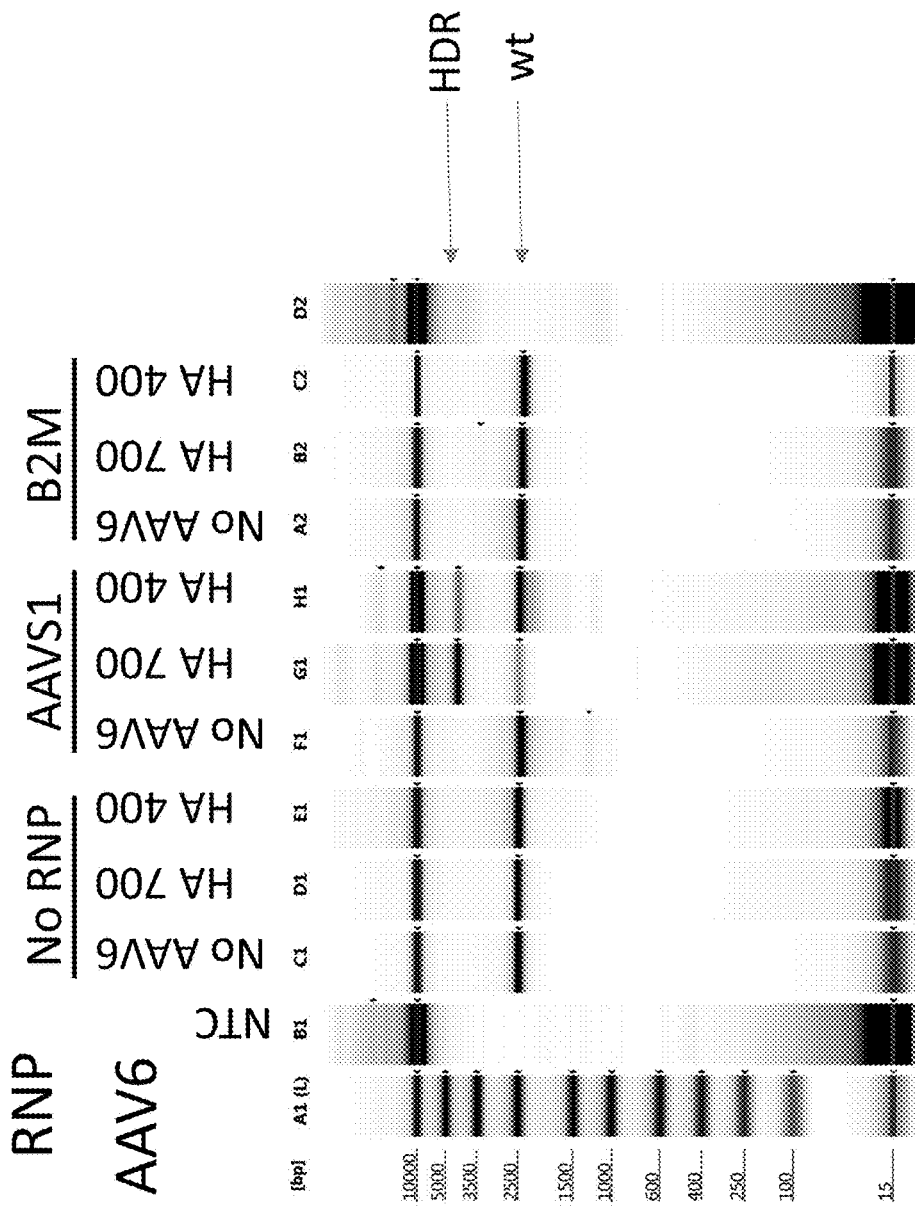
FIG. 10 is an image generated from an Agilent Tapestation analysis of DNA amplified by PCR from cells that had undergone homology directed repair of a DNA double stranded break evoked by Cas9/sgRNA RNP complex targeting a genomic site in the AAVS1 locus. The repair was facilitated by a donor template containing a GFP expression cassette flanked by homology arms around the RNP cut site and was delivered by an AAV6 virus. No RNP control and an RNP targeting a different genomic locus with no homology to the AAV donor template are also shown.

Primary human T cells were isolated and activated with anti-CD3/CD28 beads as described in Example 2. Beads were removed after 3 days. On day 4, T cells (5×10⁶) were electroporated with Cas9 alone or Cas9:AAVS1 sgRNA (targeting GGGGCCACTAGGGACAGGAT (SEQ ID NO: 1301)) RNP. 45 min. post transfection, 1×10⁶ of the Cas9 treated or the RNP treated cells were either mock transduced (control), transduced with an AAV6-MND-GFP viral vector with AAVS1 homology arms with lengths of either 400 (HA 400) or 700 (HA700) bp flanking the MND-GFP cassette (FIG. 10). Transduction with AAV6 was performed at an MOI of 50,000 viral genomes/cell. As a negative control, cells were transfected with RNP containing sgRNA targeting the B2M gene (targeting GCTACTCTCTCTTTCTGGCC (SEQ ID NO: 417)). As the AAV6-MND-GFP virus does not contain homology around the B2M genomic cut sight, any integration observed in B2M RNP treated cells would be the result of non-HDR mediated insertion. While GFP expression was observed after cutting with AAVS1, none was observed above background with use of the B2M guide, indicating the absence of non-HDR mediated insertion.

Figure 11:
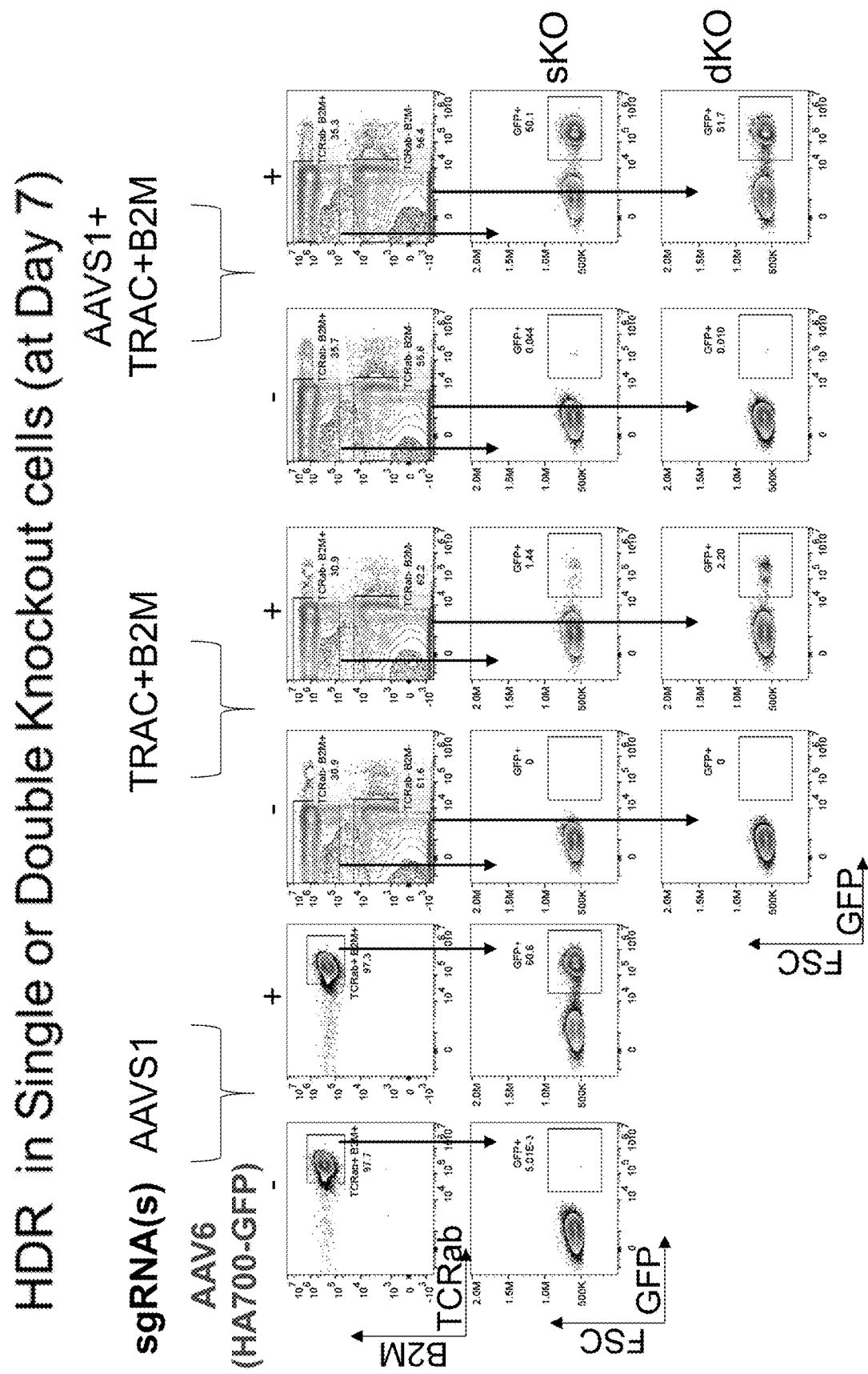
FIG. 11 shows flow cytometry plots depicting single T cells with concurrent loss of TCRα and B2M and expression of GFP after induction of HDR by a distinct RNP targeting the AAVS1 locus and AAV6 delivered donor template in primary human T cells.

To assess the efficiency of AAV6/RNP-mediated HDR, a PCR analysis (FIG. 11) was performed. Forward and reverse primers flanking the RNP cut sites were used to amplify the region of 2.3 kb. PCR products were separated on an agarose gel. A band of 4 kb indicates an insertion of the MND-GFP sequence (1.7 kb) into the locus as a result of HDR. Only in the presence of RNP targeting the AAVS1 locus was the 4 kb band evident, indicating successful insertion of the transgene by HDR. MND-GFP constructs containing 700 bp of flanking homology arms to the AAVS1 locus (HA700) appeared to lead to more efficient HDR than with homology arms of 400 bp (HA400). These data demonstrate the feasibility of performing targeting transgene insertion into primary human T cells by Cas9: sgRNA RNPs and AAV6 delivered donor DNA template. The gRNAs used in this Example comprise the following spacer sequences: AAVS1 gRNA spacer (GGGGCCACUAGGGACAGGAU (SEQ ID NO: 1308)); and B2M gRNA spacer (GCUACUCUCUCUUUCUGGCC (SEQ ID NO: 466)).

Example 8—HDR-Mediated Concurrent Transgene Insertion in Cells

This example demonstrates efficient transgene insertion and concurrent gene knockout by Cas9:sgRNA RNP (for double stranded break induction) and AAV6 delivered donor template to facilitate HDR in primary human T cells.

Figure 12:
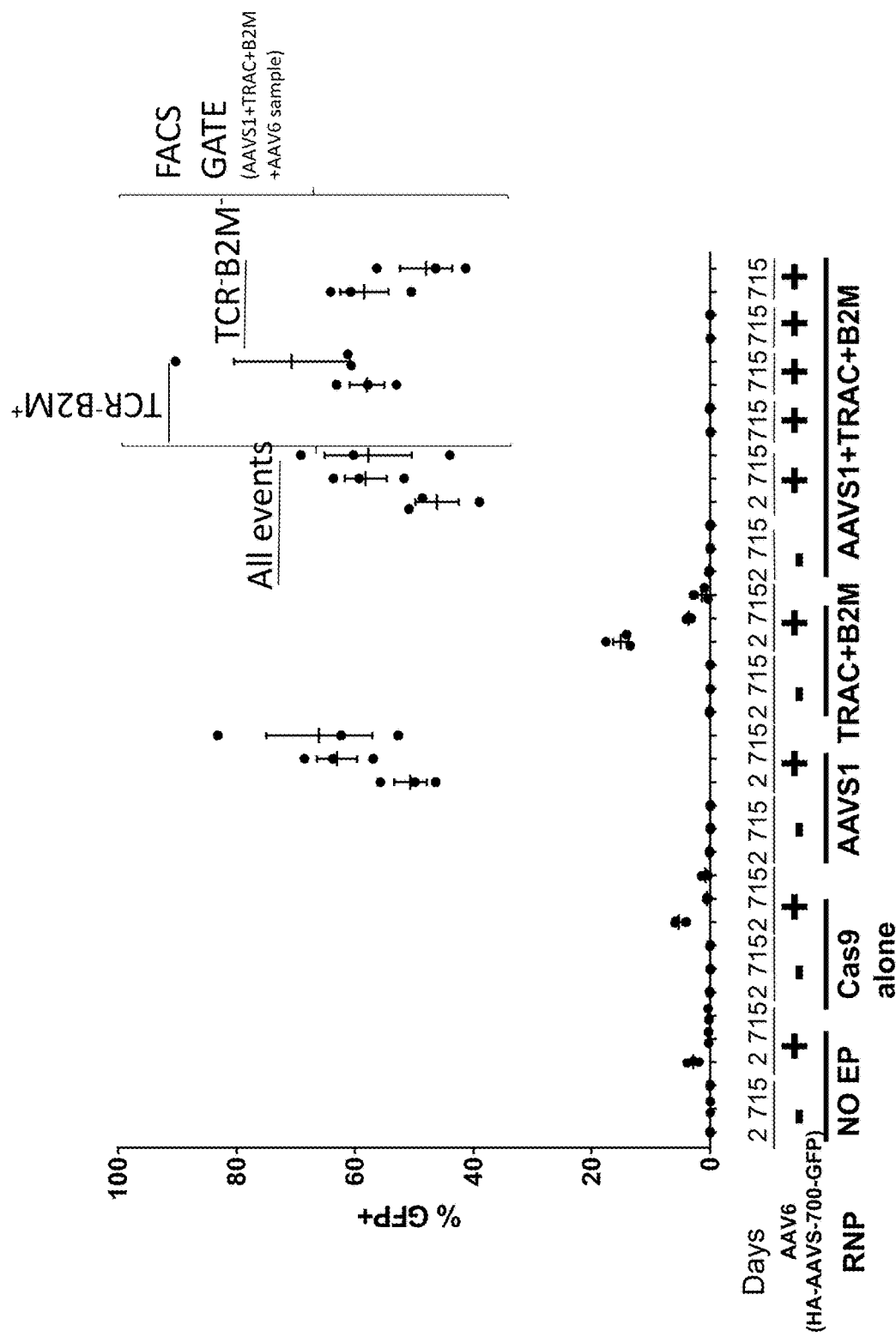
FIG. 12 is a graph quantifying the percentage of cells that are GFP positive (a readout for RNP/AAV HDR) in cells from 3 biological donors treated with controls as well as RNPs targeting AAVS1, TRAC and B2M. HDR is also quantified in gates of cells that were rendered TRAC$^-$/B2M$^+$ or TRAC$^-$/B2M$^-$ by Cas9/sgRNAs.

Primary human T cells were activated with CD3/CD28 magnetic beads (as above). Three days later activation beads were removed. The next day 5×10⁶ cells were electroporated with RNP complexes with sgRNAs targeting either AAVS1 (1 RNP), TRAC+B2M (2 separately complexed RNPs), or TRAC+B2M+AAVS1 (3 separately complexed RNPs). 1 hr post electroporation, cells were infected with −/+AAV6-MND-GFP viral vector with AAVS1 homology arms with lengths of 700 bp flanking the MND-GFP cassette (AAV6 (HA700-GFP) (FIG. 11). 7 days post manipulation cells were analyzed by flow cytometry by staining with the following antibodies PE anti-human TCRαβ (BW242/412, Miltenyi Biotech, Auburn, Calif.), APC anti-human B2M (2M2, Biolegend), and GFP detection. Cells treated with RNPs targeting TRAC+B2M showed loss of TRAC and B2M surface expression but no GFP expression in either single or double knockout cells when infected with AAV6-HA700-GFP. When TRAC+B2M treated cells are also electroporated with RNP targeting AAVS1 along with AAV6-HA700-GFP, GFP expression was evident in both single knock-out and double knock-out cells, indicative of HDR-mediated site specific insertion of the MND-GFP transgene. Finally, AAVS1 single RNP transfected cells showed high levels of transgene expression, but no loss of TCR or B2M surface expression. The same experiment was repeated with activated T cells isolated from 3 distinct biological donors (FIG. 12). The data show that high efficiency transgene insertion by Cas9:sgRNA RNP induced double stranded break and subsequent HDR from an AAV6 delivered DNA template (containing homology to the cut site) can occur with concurrent knockout of up to 2 target genes with subsequent loss of surface protein expression at the single cell level.

Guides used in this example target the following sequences:

```
                               (SEQ ID NO: 76)
    TRAC:      AGAGCAACAGTGCTGTGGCC (SEQ ID NO: 417)
    B2M:       GCTACTCTCTCTTTCTGGCC (SEQ ID NO: 1301)
    AAVS1:     GGGGCCACTAGGGACAGGAT
``` sgRNA sequences used herein: TRAC SEQ ID NO: 686, B2M SEQ ID NO: 688 and AAVS1 SEQ ID NO: 690, and can be modified as follows: TRAC SEQ ID NO: 685, B2M SEQ ID NO: 687 and AAVS1 SEQ ID NO: 689. The gRNAs used in this Example comprise the following spacer sequences: AAVS1 gRNA spacer (GGGGCCACUAGGGACAGGAU (SEQ ID NO: 1308)); TRAC gRNA spacer (AGAGCAACAGUGCUGUGGCC (SEQ ID NO: 152)); and B2M gRNA spacer (GCUACUCUCUCUUUCUGGCC (SEQ ID NO: 466)).

Example 9—CRISPR/Cas9 Mediated Knockout of TCR and MHC I Components and Expression of Chimeric Antigen Receptor Constructs This example describes the production by CRISPR/Cas9 and AAV6 of allogeneic human T cells that lack expression of the TCR and MHC I and express a chimeric antigen receptor targeting CD19+ cancers.

Figure 13A:
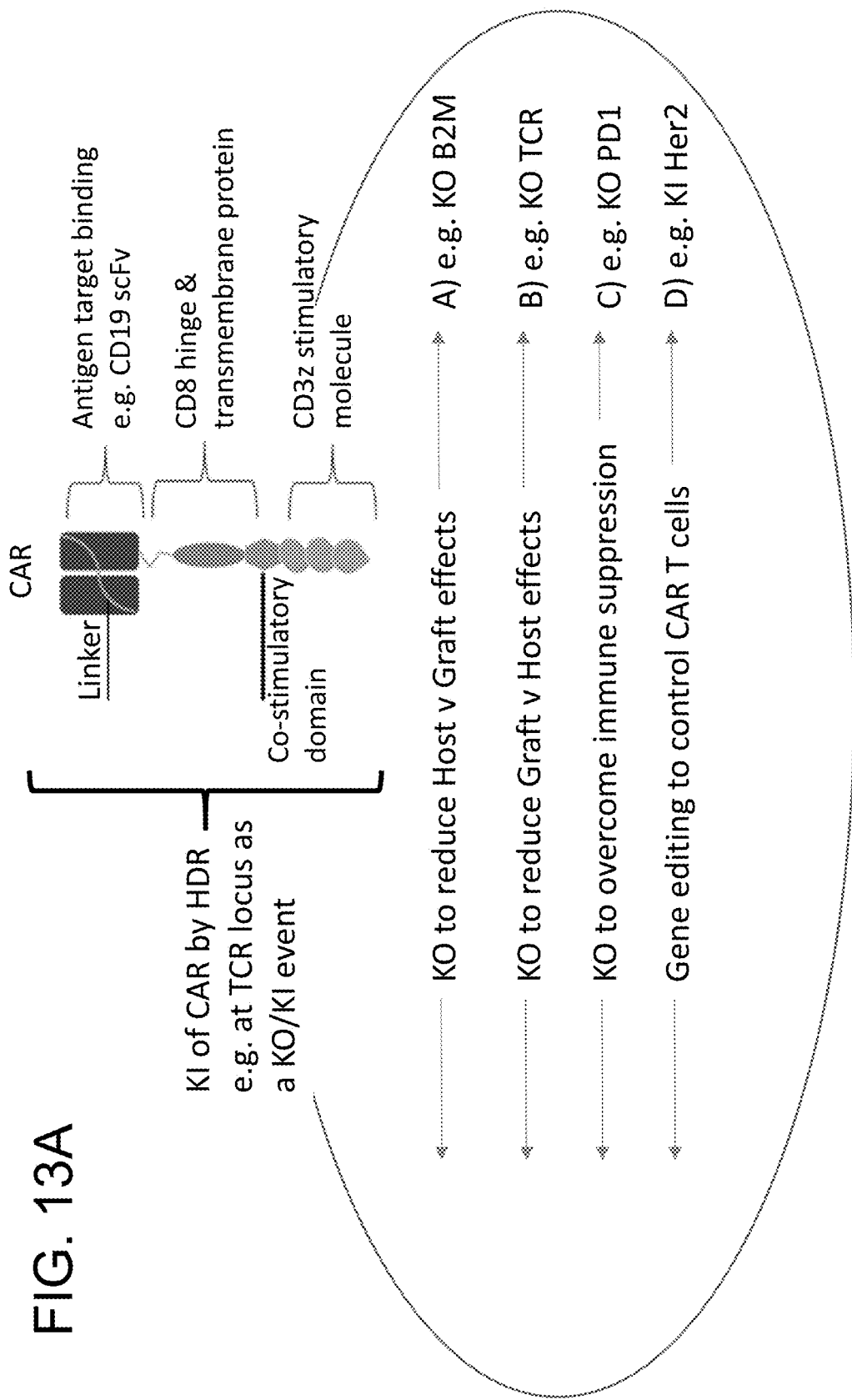
FIG. 13A is a graphical depiction of an allogeneic CAR-T cell in which expression of one more gene is modulated by CRISPR/Cas9/sgRNAs and AAV6 delivered donor templates. This depiction shows modulation of one or more target genes with knock-in of a CAR construct within or near the target gene locus as mediated by HDR.
Figure 13B:
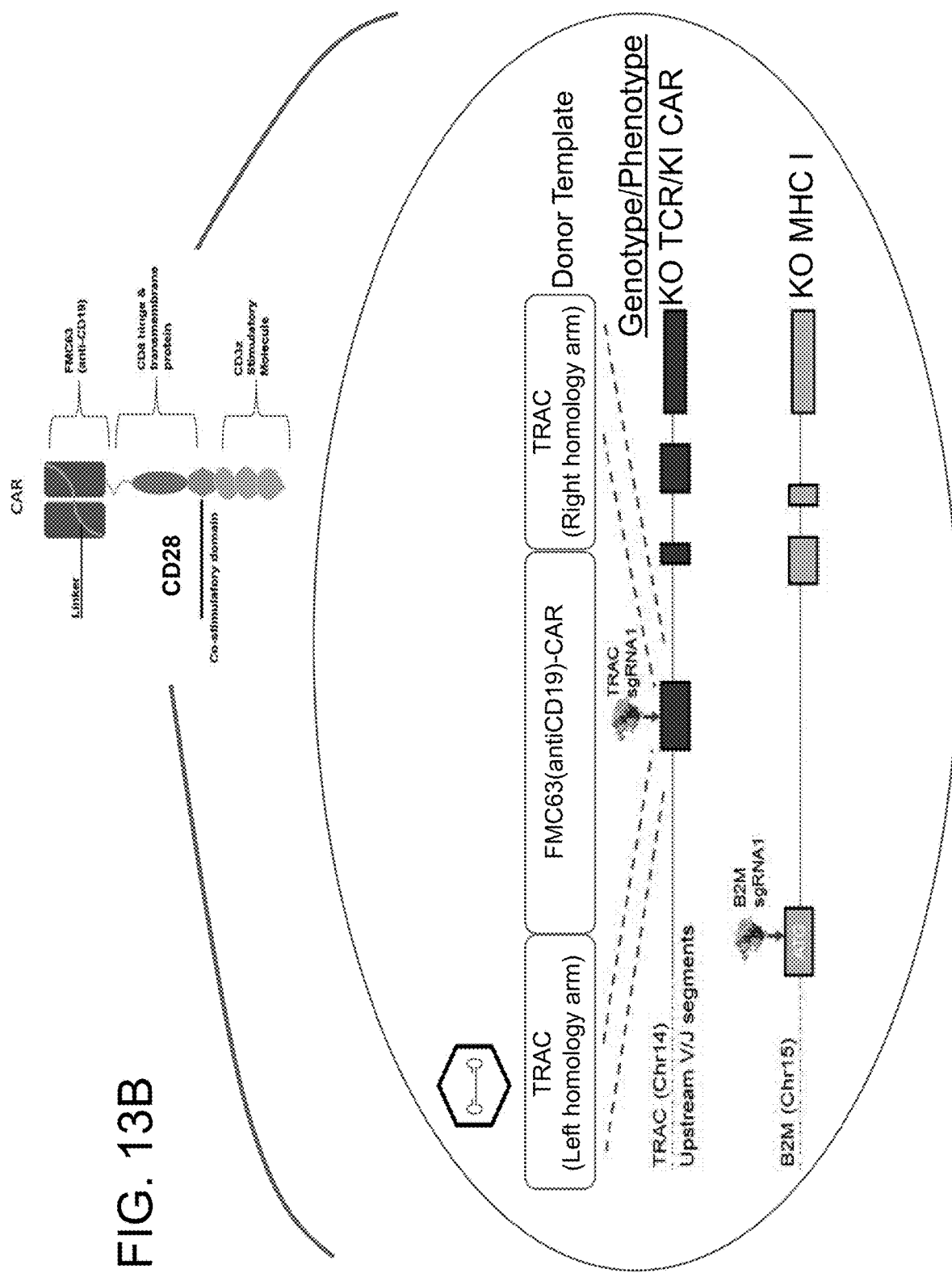
FIG. 13B is a graphical depiction of an allogeneic CAR-T cell that lacks MHC-I expression produced by CRISPR/Cas9/sgRNAs and AAV6 delivered donor templates. This depiction shows knockout of the TRAC gene with knock-in of a CAR construct into the TRAC locus (mediated by HDR). This depiction also shows deletion of sites in the B2M gene.

Schematic depiction of CRISPR/Cas9 generated allogeneic CAR-T cells is shown in FIG. 13A and FIG. 13B.

CRISPR/Cas9 was used to disrupt (knockout [KO]) the coding sequence of the TCRa constant region gene (TRAC). This disruption leads to loss of function of the TCR and renders the gene edited T cell non-alloreactive and suitable for allogeneic transplantation, minimizing the risk of graft versus host disease. The DNA double stranded break at the TRAC locus was repaired by homology directed repair with an AAV6-delivered DNA template containing right and left homology arms to the TRAC locus flanking a chimeric antigen receptor cassette (−/+ regulatory elements for gene expression). To reduce host versus graft (host vs CAR-T) and allow for persistence of the allogeneic CAR-T product, the B2M gene was disrupted by CRISPR/Cas9 components. Together, these genome edits result in a T cell with surface expression of a CAR (expressed from the TRAC locus) targeting CD19+ cancers along with loss of the TCR and MHC I, to reduce GVH and HVG disease, respectively.

Schematics of the AAV vetor genome carrying donor templates to facilitate targeted genomic insertion of CAR expression cassettes by HDR of Cas9-evoked site specific DNA double stranded breaks are shown in FIG. 14.

TABLE 12

Donor Template Component Sequences

| SEQ ID NO: | Sequence | Domain Name | Length (bp) |
|---|---|---|---|
| 1313 | TTGGCCACTCCCTCTCTGCGCGCTCGCTCGCTCACTGAG GCCGGGCGACCAAAGGTCGCCCGACGCCCGGGCTTTGC CCGGGCGGCCTCAGTGAGCGAGCGAGCGCGCAGAGAGG GAGTGGCCAACTCCATCACTAGGGGTTCCT | Left ITR (5' ITR) | 145 |
| 1576 | CCTGCAGGCAGCTGCGCGCTCGCTCGCTCACTGAGGCCG CCCGGGCGTCGGGCGACCTTTGGTCGCCCGGCCTCAGTG AGCGAGCGAGCGCGCAGAGAGGGAGTGGCCAACTCCAT CACTAGGGGTTCCT | Left ITR (5' ITR) (alternate) | 130 |
| 1314 | AGGAACCCCTAGTGATGGAGTTGGCCACTCCCTCTCTGC GCGCTCGCTCGCTCACTGAGGCCGCCCGGGCAAAGCCC GGGCGTCGGGCGACCTTTGGTCGCCCGGCCTCAGTGAGC GAGCGAGCGCGCAGAGAGGGAGTGGCCAA | Right ITR (3' ITR) | 145 |
| 1577 | AGGAACCCCTAGTGATGGAGTTGGCCACTCCCTCTCTGC GCGCTCGCTCGCTCACTGAGGCCGGGCGACCAAAGGTC GCCCGACGCCCGGGCTTTGCCCGGGCGGCCTCAGTGAG CGAGCGAGCGCGCAGCTGCCTGCAGG | Right ITR (3' ITR)(alternate) | 141 |
| 1315 | GGCCGCCAGTGTGATGGATATCTGCAGAATTCGCCCTTA TGGGGATCCGAACAGAGAGACAGCAGAATATGGGCAA ACAGGATATCTGTGGTAAGCAGTTCCTGCCCCGGCTCAG GGCCAAGAACAGTTGGAACAGCAGAATATGGGCCAAAC AGGATATCTGTGGTAAGCAGTTCCTGCCCCGGCTCAGGG CCAAGAACAGATGGTCCCCAGATGCGGTCCCGCCCTCA GCAGTTTCTAGAGAACCATCAGATGTTTCCAGGGTGCCC CAAGGACCTGAAATGACCCTGTGCCTTATTTGAACTAAC CAATCAGTTCGCTTCTCGCTTCTGTTCGCGCGCTTCTGCT CCCCGAGCTCTATATAAGCAGAGCTCGTTTAGTGAACCG TCAGATCGCCTGGAGACGCCATCCACGCTGTTTTGACCT CCATAGAAGACACCGACTCTAGAG | pMND | 451 |
| 1316 | ATGCTTCTTTTGGTTACGTCTCTGTTGCTTTGCAACTTC CTCATCCAGCGTTCTTGCTGATCCCCGATATTCAGATGA CTCAGACCACCAGTAGCTTGTCTGCCTCACTGGGAGACC GAGTAACAATCTCCTGCAGGGCAAGTCAAGACATTAGC AAATACCTCAATTGGTACCAGCAGAAGCCCGACGGAAC GGTAAAACTCCTCATCTATCATACGTCAAGGTTGCATTC CGGAGTACCGTCACGATTTTCAGGTTCTGGGAGCGGAAC TGACTATTCCTTGACTATTTCAAACCTCGAGCAGGAGGA CATTGCGACATATTTTTGTCAACAAGGTAATACCCTCCC TTACACTTTCGGAGGAGGAACCAAACTGAAATTACCG GGTCCACCAGTGGCTCTGGGAAGCCTGGCAGTGGAGAA GGTTCCACTAAAGGCGAGGTGAAGCTCCAGGAGAGCGG CCCCGGTCTCGTTGCCCCCAGTCAAAGCCTCTCTGTAAC GTGACAGTGAGTGGTGTATCATTGCCTGATTATGGCGT CTCCTGGATAAGGCAGCCCCCGCGAAAGGGTCTTGAAT GGCTTGGGGTAATATGGGCTCAGAGACAACGTATTAT AACTCCGCTCTCAAAAGTCGCTTGACGATAATAAAAGAT AACTCCAAGAGTCAAGTTTTCCTTAAAATGAACAGTTTG CAGACTGACGATACCGCTATATATTATTGTGCTAAACAT TATTACTACGGCGGTAGTTACGCGATGGATTATTGGGGG CAGGGGACTTCTGTCACAGTCAGTAGTGCTGCTGCCTTT GTCCCGGTATTCTCCCAGCCAAACCGACCACGACTCCC GCCCCGCGCCCTCCGACACCCGCTCCCACCATCGCCTCT CAACCTCTTAGTCTTCGCCCCGAGGCATGCCGACCCGCC GCCGGGGGTGCTGTTCATACGAGGGGCTTGGACTTCGCT TGTGATATTTACATTTGGGCTCCGTTGGCGGGTACGTGC GGCGTCCTTTTGTTGTCACTCGTTATTACTTTGTATTGTA ATCACAGGAATCGCTCAAAGCGGAGTAGGTTGTTGCATT CCGATTACATGAATATGACTCCTCGCCGGCCTGGGCCGA CAAGAAAACATTACCAACCCTATGCCCCCCCACGAGAC TTCGCTGCGTACAGGTCCCGAGTGAAGTTTTCCCGAAGC GCAGACGCTCCGGCATATCAGCAAGGACAGAATCAGCT GTATAACGAACTGAATTTGGGACGCCGCGAGGAGTATG ACGTGCTTGATAAACGCCGGGGAGAGACCCGGAAATG GGGGGTAAACCCCGAAGAAAGAATCCCCAAGAAGGACT CTACAATGAACTCCAGAAGGATAAGATGGCGGAGGCCT ACTCAGAAATAGGTATGAAGGGCGAACGACGACGGGA AAAGGTCACGATGCCCTCTACCAAGGGGTTGAGTACGG AACCAAAAGATACGTACGATGCACTGCATATGCAGGCCC TGCCTCCCAGA | FMC63-28Z (FMC63-CD8[tm]-CD28[co-stimulatory domain]-CD3z) | 1518 |

TABLE 12-continued

Donor Template Component Sequences

| SEQ ID NO: | Sequence | Domain Name | Length (bp) |
|---|---|---|---|
| 1317 | GGAAGCGGAGCTACTAACTTCAGCCTGCTGAAGCAGGC TGGAGACGTGGAGGAGAACCCTGGACCT | 2A | 66 |
| 1318 | ATGGTGAGCAAGGGCGAGGAGCTGTTCACCGGGGTGGT GCCCATCCTGGTCGAGCTGGACGGCGACGTAAACGGCC ACAAGTTCAGCGTGTCCGGCGAGGGCGAGGGCGATGCC ACCTACGGCAAGCTGACCCTGAAGTTCATCTGCACCACC GGCAAGCTGCCCGTGCCCTGGCCCACCCTCGTGACCACC CTGACCTACGGCGTGCAGTGCTTCAGCCGCTACCCCGAC CACATGAAGCAGCACGACTTCTTCAAGTCCGCCATGCCC GAAGGCTACGTCCAGGAGCGCACCATCTTCTTCAAGGA CGACGGCAACTACAAGACCCGCGCCGAGGTGAAGTTCG AGGGCGACACCCTGGTGAACCGCATCGAGCTGAAGGGC ATCGACTTCAAGGAGGACGGCAACATCCTGGGGCACAA GCTGGAGTACAACTACAACAGCCACAACGTCTATATCAT GGCCGACAAGCAGAAGAACGGCATCAAGGTGAACTTCA AGATCCGCCACAACATCGAGGACGGCAGCGTGCAGCTC GCCGACCACTACCAGCAGAACACCCCCATCGGCGACGG CCCCGTGCTGCTGCCCGACAACCACTACCTGAGCACCCA GTCCGCCCTGAGCAAAGACCCCAACGAGAAGCGCGATC ACATGGTCCTGCTGGAGTTCGTGACCGCCGCCGGGATCA CTCTCGGCATGGACGAGCTGTACAAGTAA | EGFP | 720 |
| 1319 | AATAAAATCGCTATCCATCGAAGATGGATGTGTGTTGGT TTTTTGTGTG | pA | 49 |
| 1320 | GAAGCCCAGAGCAGGGCCTTAGGGAAGCGGGACCCTGC TCTGGGCGGAGGAATATGTCCCAGATAGCACTGGGGAC TCTTTAAGGAAAGAAGGATGGAGAAAGAGAAAGGGAG TAGAGGCGGCCACGACCTGGTGAACACCTAGGACGCAC CATTCTCACAAAGGGAGTTTTCCACACGGACACCCCCCT CCTCACCACAGCCCTGCCAGGACGGGGCTGGCTACTGG CCTTATCTCACAGGTAAAACTGACGCACGGAGGAACAA TATAAAATTGGGGACTAGAAAGGTGAAGAGCCAAAGTTA GAACTCAGGACCAACTTATTCTGATTTTGTTTTTCCAAA CTGCTTCTCCTCTTGGGAAGTGTAAGGAAGCTGCAGCAC CAGGATCAGTGAAACGCACCAGACGGCCGCGTCAGAGC AGCTCAGGTTCTGGGAGAGGGTAGCGCAGGGTGGCCAC TGAGAACCGGGCAGGTCACGCATCCCCCCCTTCCCTCCC ACCCCCTGCCAAGCTCTCCCTCCCAGGATCCTCTCTGGC TCCATCGTAAGCAAACCTTAGAGGTTCTGGCAAGGAGA GAGATGGCTCCAGGAAATGGGGGTGTGTCACCAGATAA GGAATCTGCCTAACAGGAGGTGGGGGTTAGACCCAATA TCAGGAGACTAGGAAGGAGGAGGCCTAAGGATGGGGCT TTTCTGTCACCA | AAVS1-LHA | 700 |
| 1321 | ACTGTGGGGTGGAGGGGACAGATAAAAGTACCCAGAAC CAGAGCCACATTAACCGGCCCTGGGAATATAAGGTGGT CCCAGCTCGGGGACACAGGATCCCTGGAGGCAGCAAAC ATGCTGTCCTGAAGTGGACATAGGGGCCCGGGTTGGAG GAAGAAGACTAGCTGAGCTCTCGGACCCCTGGAAGATG CCATGACAGGGGGCTGGAAGAGCTAGCACAGACTAGAG AGGTAAGGGGGTAGGGGAGCTGCCCAAATGAAAGGA GTGAGAGGTGACCCGAATCCACAGGAGAACGGGGTGTC CAGGCAAAGAAAGCAAGAGGATGGAGAGGTGGCTAAA GCCAGGGAGACGGGGTACTTTGGGGTTGTCCAGAAAAA CGGTGATGATGCAGGCCTACAAGAAGGGGAGGCGGGAC GCAAGGGAGACATCCGTCGGAGAAGGCCATCCTAAGAA ACGAGAGATGGCACAGGCCCCAGAAGGAGAAGGAAAA GGGAACCCAGCGAGTGAAGACGGCATGGGGTTGGGTGA GGGAGGAGAGATGCCCGGAGAGGACCCAGACACGGGG AGGATCCGCTCAGAGGACATCACGTGGTGCAGCGCCGA GAAGGAAGTGCTCGGAAAGAGCATCCTTGGGCAGCAA CACAGCAGAGAGCAAGGGGAAGAGGGAGTGGAGGAAG ACGGAACCTGAAGGAGGCGGC | AAVS1-RHA | 700 |
| 1322 | GAAGATCCTATTAAATAAAAGAATAAGCAGTATTATTA AGTAGCCCTGCATTTCAGGTTTCCTTGAGTGGCAGGCCA GGCCTGGCCGTGAACGTTCACTGAAATCATGGCCTCTTG GCCAAGATTGATAGCTTGTGCCTGTCCCTGAGTCCCAGT CCATCACGAGCAGCTGGTTTCTAAGATGCTATTTCCCGT ATAAAGCATGAGACCGTGACTTGCCAGCCCCACAGAGC CCCGCCCTTGTCCATCACTGGCATCTGGACTCCAGCCTG GGTTGGGGCAAAGAGGGAAATGAGATCATGTCCTAACC | TRAC-LHA (500 bp) | 500 |

TABLE 12-continued

Donor Template Component Sequences

| SEQ ID NO: | Sequence | Domain Name | Length (bp) |
|---|---|---|---|
|  | CTGATCCTCTTGTCCCACAGATATCCAGAACCCTGACCC<br>TGCCGTGTACCAGCTGAGAGACTCTAAATCCAGTGACA<br>AGTCTGTCTGCCTATTCACCGATTTTGATTCTCAAACAA<br>ATGTGTCACAAAGTAAGGATTCTGATGTGTATATCACAG<br>ACAAAACTGTGCTAGACATGAGGTCTATGGACTTCA |  |  |
| 1323 | TGGAGCAACAAATCTGACTTTGCATGTGCAAACGCCTTC<br>AACAACAGCATTATTCCAGAAGACACCTTCTTCCCCAGC<br>CCAGGTAAGGGCAGCTTTGGTGCCTTCGCAGGCTGTTTC<br>CTTGCTTCAGGAATGGCCAGGTTCTGCCCAGAGCTCTGG<br>TCAATGATGTCTAAAACTCCTCTGATTGGTGGTCTCGGC<br>CTTATCCATTGCCACCAAAACCCTCTTTTTACTAAGAAA<br>CAGTGAGCCTTGTTCTGGCAGTCCAGAGAATGACACGG<br>GAAAAAAGCAGATGAAGAGAAGGTGGCAGGAGAGGGC<br>ACGTGGCCCAGCCTCAGTCTCTCCAACTGAGTTCCTGCC<br>TGCCTGCCTTTGCTCAGACTGTTTGCCCCTTACTGCTCTT<br>CTAGGCCTCATTCTAAGCCCCTTCTCCAAGTTGCCTCTCC<br>TTATTTCTCCCTGTCTGCCAAAAAATCTTTCCCAGCTCAC<br>TAAGTCAGTCTCACGCAGTCACTCATTAACCC | TRAC-RHA<br>(500 bp) | 500 |
| 1324 | GAGATGTAAGGAGCTGCTGTGACTTGCTCAAGGCCTTAT<br>ATCGAGTAAACGGTAGTGCTGGGGCTTAGACGCAGGTG<br>TTCTGATTTATAGTTCAAAACCTCTATCAATGAGAGAGC<br>AATCTCCTGGTAATGTGATAGATTTCCCAACTTAATGCC<br>AACATACCATAAACCTCCCATTCTGCTAATGCCCAGCCT<br>AAGTTGGGGAGACCACTCCAGATTCCAAGATGTACAGT<br>TTGCTTTGCTGGGCCTTTTTCCCATGCCTGCCTTTACTCT<br>GCCAGAGTTATATTGCTGGGGTTTTGAAGAAGATCCTAT<br>TAAATAAAAGAATAAGCAGTATTATTAAGTAGCCCTGC<br>ATTTCAGGTTTCCTTGAGTGGCAGGCCAGGCCTGGCCGT<br>GAACGTTCACTGAAATCATGGCCTCTTGGCCAAGATTGA<br>TAGCTTGTGCCTGTCCCTGAGTCCCAGTCCATCACGAGC<br>AGCTGGTTTCTAAGATGCTATTTCCCGTATAAAGCATGA<br>GACCGTGACTTGCCAGCCCCACAGAGCCCCGCCCTTGTC<br>CATCACTGGCATCTGGACTCCAGCCTGGGTTGGGGCAAA<br>GAGGGAAATGAGATCATGTCCTAACCCTGATCCTCTTGT<br>CCCACAGATATCCAGAACCCTGACCCTGCCGTGTACCAG<br>CTGAGAGACTCTAAATC | TRAC-LHA<br>(680 bp) | 678 |
| 1325 | GAGATGTAAGGAGCTGCTGTGACTTGCTCAAGGCCTTAT<br>ATCGAGTAAACGGTAGTGCTGGGGCTTAGACGCAGGTG<br>TTCTGATTTATAGTTCAAAACCTCTATCAATGAGAGAGC<br>AATCTCCTGGTAATGTGATAGATTTCCCAACTTAATGCC<br>AACATACCATAAACCTCCCATTCTGCTAATGCCCAGCCT<br>AAGTTGGGGAGACCACTCCAGATTCCAAGATGTACAGT<br>TTGCTTTGCTGGGCCTTTTTCCCATGCCTGCCTTTACTCT<br>GCCAGAGTTATATTGCTGGGGTTTTGAAGAAGATCCTAT<br>TAAATAAAAGAATAAGCAGTATTATTAAGTAGCCCTGC<br>ATTTCAGGTTTCCTTGAGTGGCAGGCCAGGCCTGGCCGT<br>GAACGTTCACTGAAATCATGGCCTCTTGGCCAAGATTGA<br>TAGCTTGTGCCTGTCCCTGAGTCCCAGTCCATCACGAGC<br>AGCTGGTTTCTAAGATGCTATTTCCCGTATAAAGCATGA<br>GACCGTGACTTGCCAGCCCCACAGAGCCCCGCCCTTGTC<br>CATCACTGGCATCTGGACTCCAGCCTGGGTTGGGGCAAA<br>GAGGGAAATGAGATCATGTCCTAACCCTGATCCTCTTGT<br>CCCACAGATATCCAGAACCCTGACCCTGCCGTGTACCAG<br>CTGAGAGACTCTAAATCCAGTGACAAGTCTGTCTGCCTA<br>TTCACCGATTTTGATTCTCAAACAAATGTGTCACAAAGT<br>AAGGATTCTGATGTGTATATCACAGACAAAACTGTGCTA<br>GACATGAGGTCTATGGACTTCA | TRAC-LHA<br>(800 bp) | 800 |
| 1326 | TGGAGCAACAAATCTGACTTTGCATGTGCAAACGCCTTC<br>AACAACAGCATTATTCCAGAAGACACCTTCTTCCCCAGC<br>CCAGGTAAGGGCAGCTTTGGTGCCTTCGCAGGCTGTTTC<br>CTTGCTTCAGGAATGGCCAGGTTCTGCCCAGAGCTCTGG<br>TCAATGATGTCTAAAACTCCTCTGATTGGTGGTCTCGGC<br>CTTATCCATTGCCACCAAAACCCTCTTTTTACTAAGAAA<br>CAGTGAGCCTTGTTCTGGCAGTCCAGAGAATGACACGG<br>GAAAAAAGCAGATGAAGAGAAGGTGGCAGGAGAGGGC<br>ACGTGGCCCAGCCTCAGTCTCTCCAACTGAGTTCCTGCC<br>TGCCTGCCTTTGCTCAGACTGTTTGCCCCTTACTGCTCTT<br>CTAGGCCTCATTCTAAGCCCCTTCTCCAAGTTGCCTCTCC<br>TTATTTCTCCCTGTCTGCCAAAAAATCTTTCCCAGCTCAC<br>TAAGTCAGTCTCACGCAGTCACTCATTAACCCACCAATC<br>ACTGATTGTGCCGGCACATGAATGCACCAGGTGTTGAA | TRAC-RHA<br>(800 bp) | 804 |

TABLE 12-continued

Donor Template Component Sequences

| SEQ ID NO: | Sequence | Domain Name | Length (bp) |
|---|---|---|---|
| | GTGGAGGAATTAAAAAGTCAGATGAGGGGTGTGCCCAG<br>AGGAAGCACCATTCTAGTTGGGGGAGCCCATCTGTCAG<br>CTGGGAAAAGTCCAAATAACTTCAGATTGGAATGTGTTT<br>TAACTCAGGGTTGAGAAAACAGCTACCTTCAGGACAAA<br>AGTCAGGGAAGGGCTCTCTGAAGAAATGCTACTTGAAG<br>ATACCAGCCCTACCAAGGGCAGGGAGAGGACCCTATAG<br>AGGCCTGGGACAGGAGCTCAATGAGAAAGG | | |
| 1327 | TAATCCTCCGGCAAACCTCTGTTTCCTCCTCAAAAGGCA<br>GGAGGTCGGAAAGAATAAACAATGAGAGTCACATTAAA<br>AACACAAAATCCTACGGAAATACTGAAGAATGAGTCTC<br>AGCACTAAGGAAAAGCCTCCAGCAGCTCCTGCTTTCTGA<br>GGGTGAAGGATAGACGCTGTGGCTCTGCATGACTCACT<br>AGCACTCTATCACGGCCATATTCTGGCAGGGTCAGTGGC<br>TCCAACTAACATTTGTTTGGTACTTTACAGTTTATTAAAT<br>AGATGTTTATATGGAGAAGCTCTCATTTCTTTCTCAGAA<br>GAGCCTGGCTAGGAAGGTGGATGAGGCACCATATTCAT<br>TTTGCAGGTGAAATTCCTGAGATGTAAGGAGCTGCTGTG<br>ACTTGCTCAAGGCCTTATATCGAGTAAACGGTAGTGCTG<br>GGGCTTAGACGCAGGTGTTCTGATTTATAGTTCAAAACC<br>TCTATCAATGAGAGCAATCTCCTGGTAATGTGATAGA<br>TTTCCCAACTTAATGCCAACATACCATAAACCTCCCATT<br>CTGCTAATGCCCAGCCTAAGTGGGGAGACCACTCCAG<br>ATTCCAAGATGTACAGTTTGCTTTGCTGGGCCTTTTTCCC<br>ATGCCTGCCTTTACTCTGCCAGAGTTATATTGCTGGGGT<br>TTTGAAGAAGATCCTATTAAATAAAAGAATAAGCAGTA<br>TTATTAAGTAGCCCTGCATTTCAGGTTTCCTTGAGTGGC<br>AGGCCAGGCCTGGCCGTGAACGTTCACTGAAATCATGG<br>CCTCTTGGCCAAGATTGATAGCTTGTGCCTGTCCCTGAG<br>TCCCAGTCCATCACGAGCAGCTGGTTTCTAAGATGCTAT<br>TTCCCGTATAAAGCATGAGACCGTGACTTGCCAGCCCCA<br>CAGAGCCCCGCCCTTGTCCATCACTGGCATCTGGACTCC<br>AGCCTGGGTTGGGGCAAAGAGGGAAATGAGATCATGTC<br>CTAACCCTGATCCTCTTGTCCCACAGATATC | TRAC-LHA<br>(1000 bp) | 1000 |
| 1328 | CCAGTGACAAGTCTGTCTGCCTATTCACCGATTTTGATT<br>CTCAAACAAATGTGTCACAAAGTAAGGATTCTGATGTGT<br>ATATCACAGACAAAACTGTGCTAGACATGAGGTCTATG<br>GACTTCAAGAGCAACAGTGCTGTGGCCTGGAGCAACAA<br>ATCTGACTTTGCATGTGCAAACGCCTTCAACAACAGCAT<br>TATTCCAGAAGACACCTTCTTCCCCAGCCCAGGTAAGGG<br>CAGCTTTGGTGCCTTCGCAGGCTGTTTCCTTGCTTCAGG<br>AATGGCCAGGTTCTGCCCAGAGCTCTGGTCAATGATGTC<br>TAAAACTCCTCTGATTGGTGGTCTCGGCCTTATCCATTG<br>CCACCAAAACCCTCTTTTTACTAAGAAACAGTGAGCCTT<br>GTTCTGGCAGTCCAGAGAATGACACGGGAAAAAAGCAG<br>ATGAAGAGAAGGTGGCAGGAGAGGGCACGTGGCCCAG<br>CCTCAGTCTCTCCAACTGAGTTCCTGCCTGCCTGCCTTTG<br>CTCAGACTGTTTGCCCCTTACTGCTCTTCTAGGCCTCATT<br>CTAAGCCCCTTCTCCAAGTTGCCTCTCCTTATTTCTCCCT<br>GTCTGCCAAAAATCTTTCCCAGCTCACTAAGTCAGTCT<br>CACGCAGTCACTCATTAACCCACCAATCACTGATTGTGC<br>CGGCACATGAATGCACCAGGTGTTGAAGTGGAGGAATT<br>AAAAAGTCAGATGAGGGGTGTGCCCAGAGGAAGCACCA<br>TTCTAGTTGGGGGAGCCCATCTGTCAGCTGGGAAAAGTC<br>CAAATAACTTCAGATTGGAATGTGTTTTAACTCAGGGTT<br>GAGAAAACAGCTACCTTCAGGACAAAAGTCAGGGAAGG<br>GCTCTCTGAAGAAATGCTACTTGAAGATACCAGCCCTAC<br>CAAGGGCAGGGAGAGGACCCTATAGAGGCCTGGGACAG<br>GAGCTCAATGAGAAAGGAGAAGAGCAGCAGGCATGAG<br>TTGAATGAAGGAGGCAGGGCCGGGTCACAGGG | TRAC-RHA<br>(1000 bp) | 999 |
| 1578 | TGTTTGGTACTTTACAGTTTATTAAATAGATGTTTATATG<br>GAGAAGCTCTCATTTCTTTCTCAGAAGAGCCTGGCTAGG<br>AAGGTGGATGAGGCACCATATTCATTTTGCAGGTGAAAT<br>TCCTGAGATGTAAGGAGCTGCTGTGACTTGCTCAAGGCC<br>TTATATCGAGTAAACGGTAGTGCTGGGGCTTAGACGCA<br>GGTGTTCTGATTTATAGTTCAAAACCTCTATCAATGAGA<br>GAGCAATCTCCTGGTAATGTGATAGATTTCCCAACTTAA<br>TGCCAACATACCATAAACCTCCCATTCTGCTAATGCCCA<br>GCCTAAGTGGGGAGACCACTCCAGATTCCAAGATGTA<br>CAGTTTGCTTTGCTGGGCCTTTTTCCCATGCCTGCCTTTA<br>CTCTGCCAGAGTTATATTGCTGGGGTTTTGAAGAAGATC<br>CTATTAAATAAAAGAATAAGCAGTATTATTAAGTAGCCC<br>TGCATTTCAGGTTTCCTTGAGTGGCAGGCCAGGCCTGGC | TRAC-LHA used<br>in CTX-139.1 | 800 |

TABLE 12-continued

Donor Template Component Sequences

| SEQ ID NO: | Sequence | Domain Name | Length (bp) |
|---|---|---|---|
| | CGTGAACGTTCACTGAAATCATGGCCTCTTGGCCAAGAT<br>TGATAGCTTGTGCCTGTCCCTGAGTCCCAGTCCATCACG<br>AGCAGCTGGTTTCTAAGATGCTATTTCCCGTATAAAGCA<br>TGAGACCGTGACTTGCCAGCCCCACAGAGCCCCGCCCTT<br>GTCCATCACTGGCATCTGGACTCCAGCCTGGGTTGGGGC<br>AAAGAGGGAAATGAGATCATGTCCTAACCCTGATCCTCT<br>TGTCCCACAGATATCCAGAACCCTGACCCTGCCGTGTAC<br>CAGCTGAGAGACTCTAAATC | | |
| 1579 | TGTTTGGTACTTTACAGTTTATTAAATAGATGTTTATATG<br>GAGAAGCTCTCATTTCTTTCTCAGAAGAGCCTGGCTAGG<br>AAGGTGGATGAGGCACCATATTCATTTTGCAGGTGAAAT<br>TCCTGAGATGTAAGGAGCTGCTGTGACTTGCTCAAGGCC<br>TTATATCGAGTAAACGGTAGTGCTGGGGCTTAGACGCA<br>GGTGTTCTGATTTATAGTTCAAAACCTCTATCAATGAGA<br>GAGCAATCTCCTGGTAATGTGATAGATTTCCCAACTTAA<br>TGCCAACATACCATAAACCTCCCATTCTGCTAATGCCCA<br>GCCTAAGTTGGGGAGACCACTCCAGATTCCAAGATGTA<br>CAGTTTGCTTTGCTGGGCCTTTTTCCCATGCCTGCCTTTA<br>CTCTGCCAGAGTTATATTGCTGGGGTTTTGAAGAAGATC<br>CTATTAAATAAAAGAATAAGCAGTATTATTAAGTAGCCC<br>TGCATTTCAGGTTCCTTGAGTGGCAGGCCAGGCCTGGC<br>CGTGAACGTTCACTGAAATCATGGCCTCTTGGCCAAGAT<br>TGATAGCTTGTGCCTGTCCCTGAGTCCCAGTCCATCACG<br>AGCAGCTGGTTTCTAAGATGCTATTTCCCGTATAAAGCA<br>TGAGACCGTGACTTGCCAGCCCCACAGAGCCCCGCCCTT<br>GTCCATCACTGGCATCTGGACTCCAGCCTGGGTTGGGGC<br>AAAGAGGGAAATGAGATCATGTCCTAACCCTGATCCTCT<br>TGTCCCACAGATATCCAGAACCCTGACCCTGCCGTGTAC<br>CAGCTGAGAGACTCTAAATCCAGTGACAAGTCTGTCTGC<br>C | TRAC-LHA used in CTX-139.2 | |
| 1580 | TGGAGCAACAAATCTGACTTTGCATGTGCAAACGCCTTC<br>AACAACAGCATTATTCCAGAAGACACCTTCTTCCCCAGC<br>CCAGGTAAGGGCAGCTTTGGTGCCTTCGCAGGCTGTTTC<br>CTTGCTTCAGGAATGGCCAGGTTCTGCCCAGAGCTCTGG<br>TCAATGATGTCTAAAACTCCTCTGATTGGTGGTCTCGGC<br>CTTATCCATTGCCACCAAAACCCTCTTTTTACTAAGAAA<br>CAGTGAGCCTTGTTCTGGCAGTCCAGAGAATGACACGG<br>GAAAAAAGCAGATGAAGAGAAGGTGGCAGGAGAGGGC<br>ACGTGGCCCAGCCTCAGTCTCTCCAACTGAGTTCCTGCC<br>TGCCTGCCTTTGCTCAGACTGTTTGCCCCTTACTGCTCTT<br>CTAGGCCTCATTCTAAGCCCCTTCTCCAAGTTGCCTCTCC<br>TTATTTCTCCCTGTCTGCCAAAAAATCTTTCCCAGCTCAC<br>TAAGTCAGTCTCACGCAGTCACTCATTAACCCACCAATC<br>ACTGATTGTGCCGGCACATGAATGCACCAGGTGTTGAA<br>GTGGAGGAATTAAAAAGTCAGATGAGGGGTGTGCCCAG<br>AGGAAGCACCATTCTAGTTGGGGGAGCCCATCTGTCAG<br>CTGGGAAAAGTCCAAATAACTTCAGATTGGAATGTGTTT<br>TAACTCAGGGTTGAGAAAACAGCTACCTTCAGGACAAA<br>AGTCAGGGAAGGGCTCTCTGAAGAAATGCTACTTGAAG<br>ATACCAGCCCTACCAAGGGCAGGGAGAGGACCCTATAG<br>AGGCCTGGGACAGGAGCTCAATGAGAAAGG | TRAC-RHA used in CTX-139.2 | |
| 1581 | TGTTTGGTACTTTACAGTTTATTAAATAGATGTTTATATG<br>GAGAAGCTCTCATTTCTTTCTCAGAAGAGCCTGGCTAGG<br>AAGGTGGATGAGGCACCATATTCATTTTGCAGGTGAAAT<br>TCCTGAGATGTAAGGAGCTGCTGTGACTTGCTCAAGGCC<br>TTATATCGAGTAAACGGTAGTGCTGGGGCTTAGACGCA<br>GGTGTTCTGATTTATAGTTCAAAACCTCTATCAATGAGA<br>GAGCAATCTCCTGGTAATGTGATAGATTTCCCAACTTAA<br>TGCCAACATACCATAAACCTCCCATTCTGCTAATGCCCA<br>GCCTAAGTTGGGGAGACCACTCCAGATTCCAAGATGTA<br>CAGTTTGCTTTGCTGGGCCTTTTTCCCATGCCTGCCTTTA<br>CTCTGCCAGAGTTATATTGCTGGGGTTTTGAAGAAGATC<br>CTATTAAATAAAAGAATAAGCAGTATTATTAAGTAGCCC<br>TGCATTTCAGGTTCCTTGAGTGGCAGGCCAGGCCTGGC<br>CGTGAACGTTCACTGAAATCATGGCCTCTTGGCCAAGAT<br>TGATAGCTTGTGCCTGTCCCTGAGTCCCAGTCCATCACG<br>AGCAGCTGGTTTCTAAGATGCTATTTCCCGTATAAAGCA<br>TGAGACCGTGACTTGCCAGCCCCACAGAGCCCCGCCCTT<br>GTCCATCACTGGCATCTGGACTCCAGCCTGGGTTGGGGC<br>AAAGAGGGAAATGAGATCATGTCCTAACCCTGATCCTCT<br>TGTCCCACAGATATCCAGAACCCTGACCCTGCCGTGTAC<br>CAGCTGAGAGACTCTAAATCCAGTGACAAGTCTGTCTGA | TRAC-LHA (841 bp) used in CTX-139.3 | |

TABLE 12-continued

Donor Template Component Sequences

| SEQ ID NO: | Sequence | Domain Name | Length (bp) |
|---|---|---|---|
| | CTATTCACCGATTTTGATTCTC | | |
| 1582 | ATTCACCGATTTTGATTCTCAAACAAATGTGTCACAAAG<br>TAAGGATTCTGATGTGTATATCACAGACAAAACTGTGCT<br>AGACATGAGGTCTATGGACTTCAAGAGCAACAGTGCTG<br>TGGCCTGGAGCAACAAATCTGACTTTGCATGTGCAAACG<br>CCTTCAACAACAGCATTATTCCAGAAGACACCTTCTTCC<br>CCAGCCCAGGTAAGGGCAGCTTTGGTGCCTTCGCAGGCT<br>GTTTCCTTGCTTCAGGAATGGCCAGGTTCTGCCCAGAGC<br>TCTGGTCAATGATGTCTAAAACTCCTCTGATTGGTGGTC<br>TCGGCCTTATCCATTGCCACCAAAACCCTCTTTTTACTAA<br>GAAACAGTGAGCCTTGTTCTGGCAGTCCAGAGAATGAC<br>ACGGGAAAAAAGCAGATGAAGAGAAGGTGGCAGGAGA<br>GGGCACGTGGCCCAGCCTCAGTCTCTCCAACTGAGTTCC<br>TGCCTGCCTGCCTTTGCTCAGACTGTTTGCCCCTTACTGC<br>TCTTCTAGGCCTCATTCTAAGCCCCTTCTCCAAGTTGCCT<br>CTCCTTATTTCTCCCTGTCTGCCAAAAAATCTTTCCCAGC<br>TCACTAAGTCAGTCTCACGCAGTCACTCATTAACCCACC<br>AATCACTGATTGTGCCGGCACATGAATGCACCAGGTGTT<br>GAAGTGGAGGAATTAAAAAGTCAGATGAGGGGTGTGCC<br>CAGAGGAAGCACCATTCTAGTTGGGGGAGCCCATCTGT<br>CAGCTGGGAAAAGTCCAAATAACTTCAGATTGGAATGT<br>GTTTTAACTCAGGGTTGAGAAAACAGCTACCTTCAGGAC<br>AAAAGTCAGGGAAGGGCTCTCTGAAGAAATGCTACTTG<br>AAGATACCAGCCCTACCAAGGGCAGGGAGAGGACCCTA<br>TAGAGGCCTGGGACAGGAGCTCAATGAGAAAGG | TRAC-RHA<br>(905 bp) used in<br>CTX-139.3 | |
| 1329 | TTTTGTAAAGAATATAGGTAAAAAGTGGCATTTTTTCTT<br>TGGATTTAATTCTTATGGATTTAAGTCAACATGTATTTTC<br>AAGCCAACAAGTTTTGTTAATAAGATGGCTGCACCCTGC<br>TGCTCCATGCCAGATCCACCACACAGAAAGCAAATGTTC<br>AGTGCATCTCCCTCTTCCTGTCAGAGCTTATAGAGGAAG<br>GAAGACCCCGCAATGTGGAGGCATATTGTATTACAATTA<br>CTTTTAATGGCAAAAACTGCAGTTACTTTTGTGCCAACC<br>TACTACATGGTCTGGACAGCTAAATGTCATGTATTTTTC<br>ATGGCCCCTCCAGGTATTGTCAGAGTCCTCTTGTTTGGC<br>CTTCTAGGAAGGCTGTGGGACCCAGCTTTCTTCAACCAG<br>TCCAGGTGGAGGCCTCTGCCTTGAACGTTTCCAAGTGAG<br>GTAAAACCCGCAGGCCCAGAGGCCTCTCTACTTCCTGTG<br>TGGGGTTCAGAAACCCTCCTCCCCTCCCAGCCTCAGGTG<br>CCTGCTTCAGAAAATGGTGAGTCTCTCTTATAAAGCC<br>CTCCTTTTTCATCCTAGCATTGGGAACAATGGCCCCAGG<br>GTCCTTATCTCTAGCAGATGTTTTGAAAAAGTCATCTGT<br>TTTGCTTTTTTTCCAGAAGTAGTAAGTCTGCTGGCCTCCG<br>CCATCTTAGTAAAGTAACAGTCCCATGAAACAAAG | CD3E-LHA<br>(700 bp) | 700 |
| 1330 | GTGAGTAGGATGGAGTGGAAAGGGTGGTGTGTCTCCAG<br>ACCGCTGGAAGGCTTACAGCCTTACCTGGCACTGCCTAG<br>TGGCACCAAGGAGCCTCATTTACCAGATGTAAGGAACT<br>GTTTGTGCTATGTTAGGGTGAGGGATTAGAGCTGGGGAC<br>TAAAGAAAAGATAGGCCACGGGTGCCTGGGAGAGCGT<br>TCGGGGAGCAGGCAAAGAAGAGCAGTTGGGGTGATCAT<br>AGCTATTGTGAGCAGAGAGGTCTCGCTACCTCTAAGTAC<br>GAGCTCATTCCAACTTACCCAGCCCTCCAGAACTAACCC<br>AAAAGAGACTGGAAGAGCGAAGCTCCACTCCTTGTTTT<br>GAAGAGACCAGATACTTGCGTCCAAACTCTGCACAGGG<br>CATATATAGCAATTCACTATCTTTGAGACCATAAAACGC<br>CTCGTAATTTTTAGTCCTTTTCAAGTGACCAACAACTTTC<br>AGTTTATTTCATTTTTTTGAAGCAAGATGGATTATGAATT<br>GATAAATAACCAAGAGCATTTCTGTATCTCATATGAGAT<br>AAATAATACCAAAAAAGTTGCCATTTATTGTCAGATAC<br>TGTGTAAAGAAAAAATTATTTAGACGTGTTAACTGGTTT<br>AATCCTACTTCTGCCTAGGAAGGAAGGTGTTATATCCTC<br>TTTTTAAAATTCTTTTTAATTTTGACTATATAAACTGATA<br>A | CD3E-RHA<br>(700 bp) | 700 |
| 1331 | GGCTCCGGTGCCCGTCAGTGGGCAGAGCGCACATCGCC<br>CACAGTCCCCGAGAAGTTGGGGGGAGGGGTCGGCAATT<br>GAACCGGTGCCTAGAGAAGGTGGCGCGGGGTAAACTGG<br>GAAAGTGATGTCGTGTACTGGCTCCGCCTTTTTCCCGAG<br>GGTGGGGGAGAACCGTATATAAGTGCAGTAGTCGCCGT<br>GAACGTTCTTTTTCGCAACGGGTTTGCCGCCAGAACACA<br>GGTAAGTGCCGTGTGTGGTTCCCGCGGGCCTGGCCTCTT<br>TACGGGTTATGGCCCTTGCGTGCCTTGAATTACTTCCAC<br>TGGCTGCAGTACGTGATTCTTGATCCCGAGCTTCGGGTT | EF1a | 1178 |

TABLE 12-continued

Donor Template Component Sequences

| SEQ ID NO: | Sequence | Domain Name | Length (bp) |
|---|---|---|---|
|  | GGAAGTGGGTGGGAGAGTTCGAGGCCTTGCGCTTAAGG AGCCCCTTCGCCTCGTGCTTGAGTTGAGGCCTGGCCTGG GCGCTGGGGCCGCCGCGTGCGAATCTGGTGGCACCTTCG CGCCTGTCTCGCTGCTTTCGATAAGTCTCTAGCCATTTAA AATTTTTGATGACCTGCTGCGACGCTTTTTTCTGGCAAG ATAGTCTTGTAAATGCGGGCCAAGATCTGCACACTGGTA TTTCGGTTTTTGGGGCCGCGGGCGGCGACGGGGCCCGTG CGTCCCAGCGCACATGTTCGGCGAGGCGGGGCCTGCGA GCGCGGCCACCGAGAATCGGACGGGGGTAGTCTCAAGC TGGCCGGCCTGCTCTGGTGCCTGGCCTCGCGCCGCCGTG TATCGCCCCGCCCTGGGCGGCAAGGCTGGCCCGGTCGG CACCAGTTGCGTGAGCGGAAAGATGGCCGCTTCCCGGC CCTGCTGCAGGGAGCTCAAAATGGAGGACGCGGCGCTC GGGAGAGCGGGCGGGTGAGTCACCCACACAAAGGAAA AGGGCCTTTCCGTCCTCAGCCGTCGCTTCATGTGACTCC ACGGAGTACCGGGCGCCGTCCAGGCACCTCGATTAGTTC TCGAGCTTTTGGAGTACGTCGTCTTTAGGTTGGGGGGAG GGGTTTTATGCGATGGAGTTTCCCCACACTGAGTGGGTG GAGACTGAAGTTAGGCCAGCTTGGCACTTGATGTAATTC TCCTTGGAATTTGCCCTTTTTGAGTTTGGATCTTGGTTCA TTCTCAAGCCTCAGACAGTGGTTCAAAGTTTTTTCTTCC ATTTCAGGTGTCGTGA |  |  |

FMC63-28Z (FMC63-CD8[tm]-CD28[co-stimulatory domain]-CD3Z) Component Sequences

| 1332 | ATGCTTCTTTTGGTTACGTCTCTGTTGCTTTGCGAACTTC CTCATCCAGCGTTCTTGCTGATCCCC | GM-CSF signal peptide |  |
| 1598 | MLLLVTSLLLCELPHPAFLLIP | GM-CSF signal peptide |  |
| 1333 | GATATTCAGATGACTCAGACCACCAGTAGCTTGTCTGCC TCACTGGGAGACCGAGTAACAATCTCCTGCAGGGCAAG TCAAGACATTAGCAAATACCTCAATTGGTACCAGCAGA AGCCCGACGGAACGGTAAAACTCCTCATCTATCATACGT CAAGGTTGCATTCCGGAGTACCGTCACGATTTTCAGGTT CTGGGAGCGGAACTGACTATTCCTTGACTATTTCAAACC TCGAGCAGGAGGACATTGCGACATATTTTGTCAACAAG GTAATACCCTCCCTTACACTTTCGGAGGAGGAACCAAAC TCGAAATTACCGGGTCCACCAGTGGCTCTGGGAAGCCTG GCAGTGGAGAAGGTTCCACTAAAGGCGAGGTGAAGCTC CAGGAGAGCGGCCCCGGTCTCGTTGCCCCCAGTCAAAG CCTCTCTGTAACGTGCACAGTGAGTGGTGTATCATTGCC TGATTATGCGTCTCCTGGATAAGGCAGCCCCCGCGAAA GGGTCTTGAATGGCTTGGGGTAATATGGGGCTCAGAGA CAACGTATTATAACTCCGCTCTCAAAAGTCGCTTGACGA TAATAAAAGATAACTCCAAGAGTCAAGTTTTCCTTAAAA TGAACAGTTTGCAGACTGACGATACCGCTATATATTATT GTGCTAAACATTATTACTACGGCGGTAGTTACGCGATGG ATTATTGGGGCAGGGGACTTCTGTCACAGTCAGTAGT | Anti-CD19 scFv |  |
| 1334 | DIQMTQTTSSLSASLGDRVTISCRASQDISKYLNWYQQKPD GTVKLLIYHTSRLHSGVPSRFSGSGSGTDYSLTISNLEQEDI ATYFCQQGNTLPYTFGGGTKLEIT<u>GSTSGSGKPGSGEGSTK</u> <u>GEVKL</u>QESGPGLVAPSQSLSVTCTVSGVSLPDYGVSWIRQP PRKGLEWLGVIWGSETTYYNSALKSRLTIIKDNSKSQVFLK MNSLQTDDTAIYYCAKHYYYGGSYAMDYWGQGTSVTVS S | CD19 scFv amino acid sequence Linker underlined |  |
| 1335 | <u>GCTGCTGCC</u>TTTGTCCCGGTATTTCTCCCAGCCAAACCG ACCACGACTCCCGCCCCGCGCCCTCCGACACCCGCTCCC ACCATCGCCTCTCAACCTCTTAGTCTTCGCCCCGAGGCA TGCCGACCCGCCGCCGGGGTGCTGTTCATACGAGGGG CTTGGACTTCGCTTGTGATATTTACATTTGGGCTCCGTTG GCGGGTACGTGCGGCGTCCTTTTGTTGTCACTCGTTATT ACTTTGTATTGTAATCACAGGAATCGC | CD8a transmembrane + 5' Linker (underlined) |  |
| 1599 | TTTGTCCCGGTATTTCTCCCAGCCAAACCGACCACGACT CCCGCCCCGCGCCCTCCGACACCCGCTCCCACCATCGCC TCTCAACCTCTTAGTCTTCGCCCCGAGGCATGCCGACCC GCCGCCGGGGTGCTGTTCATACGAGGGGCTTGGACTTC GCTTGTGATATTTACATTTGGGCTCCGTTGGCGGGTACG TGCGGCGTCCTTTTGTTGTCACTCGTTATTACTTTGTATT GTAATCACAGGAATCGC | CD8a transmembrane (without linker) |  |

TABLE 12-continued

Donor Template Component Sequences

| SEQ ID NO: | Sequence | Domain Name | Length (bp) |
|---|---|---|---|
| 1600 | FVPVFLPAKPTTTPAPRPPTPAPTIASQPLSLRPEACRPAAG GAVHTRGLDFACDIYIWAPLAGTCGVLLLSLVITLYCNHR NR | CD8a transmembrane | |
| 1336 | TCAAAGCGGAGTAGGTTGTTGCATTCCGATTACATGAAT ATGACTCCTCGCCGGCCTGGGCCGACAAGAAAACATTA CCAACCCTATGCCCCCCCACGAGACTTCGCTGCGTACAG GTCC | CD28 co-stimulatory | |
| 1601 | SKRSRLLHSDYMNMTPRRPGPTRKHYQPYAPPRDFAAYRS | CD28 co-stimulatory | |
| 1337 | CGAGTGAAGTTTTCCCGAAGCGCAGACGCTCCGGCATAT CAGCAAGGACAGAATCAGCTGTATAACGAACTGAATTT GGGACGCCGCGAGGAGTATGACGTGCTTGATAAACGCC GGGGGAGAGACCCGGAAATGGGGGGTAAACCCCGAAG AAAGAATCCCCAAGAAGGACTCTACAATGAACTCCAGA AGGATAAGATGGCGGAGGCCTACTCAGAAATAGGTATG AAGGGCGAACGACGACGGGGAAAAGGTCACGATGGCCT CTACCAAGGGTTGAGTACGGCAACCAAAGATACGTACG ATGCACTGCATATGCAGGCCCTGCCTCCCAGA | CD3z | |
| 1602 | RVKFSRSADAPAYQQGQNQLYNELNLGRREEYDVLDKRR GRDPEMGGKPRRKNPQEGLYNELQKDKMAEAYSEIGMKG ERRRGKGHDGLYQGLSTATKDTYDALHMQALPPR | CD3z peptide | |
| 1338 | MLLLVTSLLLCELPHPAFLLIPDIQMTQTTSSLSASLGDRVT ISCRASQDISKYLNWYQQKPDGTVKLLIYHTSRLHSGVPSR FSGSGSGTDYSLTISNLEQEDIATYFCQQGNTLPYTFGGGT KLEITGSTSGSGKPGSGEGSTKGEVKLQESGPGLVAPSQSL SVTCTVSGVSLPDYGVSWIRQPPRKGLEWLGVIWGSETTY YNSALKSRLTIIKDNSKSQVFLKMNSLQTDDTAIYYCAKH YYYGGSYAMDYWGQGTSVTVSSAAAFVPVFLPAKPTTTP APRPPTPAPTIASQPLSLRPEACRPAAGGAVHTRGLDFACDI YIWAPLAGTCGVLLLSLVITLYCNHRNRSKRSRLLHSDYM NMTPRRPGPTRKHYQPYAPPRDFAAYRSRVKFSRSADAPA YQQGQNQLYNELNLGRREEYDVLDKRRGRDPEMGGKPR RKNPQEGLYNELQKDKMAEAYSEIGMKGERRRGKGHDGL YQGLSTATKDTYDALHMQALPPR | FMC63-28Z (FMC63-CD8[tm]-CD28[co-stimulatory domain]-CD3z) Amino Acid CD8a transmembrane underlined | |

CTX-131 (SEQ ID NO: 1348) contains a CAR (FMC63-CD8[tm]-CD28[co-stimulatory domain]-CD3z) construct (SEQ ID NO: 1316) with a synthetic 3' poly adenylation sequence (pA) whose expression is driven by the MND promoter and is translationally linked by a picornavirus 2A sequence to any potential downstream transcript (GFP is shown in this example). CTX-131 contains homology arms flanking a genomic Cas9/sgRNA target site in the AAVS1 locus. CTX-132 (SEQ ID NO: 1349) is the same version of this construct, but lacking homology arms to AAVS1.

CTX-133 (SEQ ID NO: 1350) contains a CAR (FMC63-CD8[tm]-CD28[co-stimulatory domain]-CD3z) construct (SEQ ID NO: 1316) with a synthetic 3' poly adenylation sequence (pA) whose expression is driven by the EF1a promoter and is translationally linked by a picornavirus 2A sequence to any potential downstream transcript (GFP is shown in this example). CTX-133 contains homology arms flanking a genomic Cas9/sgRNA target site in the TRAC locus. CTX-134 (SEQ ID NO: 1351) is the same version of this construct, but lacking homology arms to TRAC. CTX-138 (SEQ ID NO: 1354) is a version of CTX-133 lacking the 2A-GFP sequence, and the 500 bp flanking homology arms are replaced with 800 bp flanking homology arms. CTX-139 (SEQ ID NO: 1355) is a version of CTX-138 where the TRAC left homology arm was replaced with a 678 bp homology arm (TRAC-LHA (680 bp)).

CTX-140 (SEQ ID NO: 1356) contains a CAR (FMC63-CD8[tm]-CD28[co-stimulatory domain]-CD3z) construct (SEQ ID NO: 1316) with a synthetic 3' poly adenylation sequence (pA) whose expression is driven by endogenous TCR regulatory elements and is translationally linked by a picornavirus 2A sequence to any potential upstream TCRa transcript. CTX-140 contains homology arms flanking a genomic Cas9/sgRNA target site in the TRAC locus (distinct from CTX-133, CTX-138, and CTX-139). CTX-141 (SEQ ID NO: 1357) is the same version of the CTX-140 construct and is also translationally linked to any potential downstream sequence by an additional 2A sequence (GFP is shown in this example).

CTX-139.1 construct (SEQ ID NO: 1583) is a similar version of the CTX-139 construct however the left homology arm (LHA) sequence is replaced with an alternate 800 bp TRAC-LHA, creating a larger deletion upon homologous recombination. CTX-139.2 is similar to CTX139.1 but with an extended 20 bp LHA and 105 bp RHA that brings homologous sequence closer to the Exon1_T7 guide cut site but is missing the Exon1_T7 guide target sequence. CTX-139.3 is similar to CTX-139.2 with an additional 21 bp added to the LHA and 20 bp added to the RHA. CTX-139.2 contains all the Exon1_T7 guide target sequence but has a mutation in the corresponding PAM sequence.

CTX-135 (SEQ ID NO: 1352) contains a CAR (FMC63-CD8[tm]-CD28[co-stimulatory domain]-CD3z) construct (SEQ ID NO: 1316) with a synthetic 3' poly adenylation sequence (pA) whose expression is driven by endogenous CD3E regulator elements and is translationally linked by a picornavirus 2A sequence to any potential downstream transcript (GFP is shown in this example). CTX-135 contains 700 bp homology arms flanking a genomic Cas9/sgRNA target site in the CD3E locus. CTX-136 (SEQ ID NO: 1353) is a version of CTX-135 but lacking homology arms to CD3E.

CRISPR/Cas9 Mediated Knockout of TCR and MHC I Components, Expression of Chimeric Antigen Receptor (CAR) Constructs, and Retained Effector Function This example describes the production by CRISPR/Cas9 and AAV6 of allogeneic human T cells that lack expression of TCR and MHC I, that express a chimeric antigen receptor targeting CD19+ cancers, and that retain T cell effector function.

Transgene insertion in primary human T cells via homology directed repair (HDR) and concurrent gene knockout by Cas9:sgRNA RNA was performed as described above in Examples 8 and 9. Primary human T cells were first electroporated with Cas9 or Cas9:sgRNA RNP complexes targeting TRAC (AGAGCAACAGTGCTGTGGCC (SEQ ID NO: 76)), B2M1 (GCTACTCTCTCTTTCTGGCC (SEQ ID NO: 417)), or AAVS1 (GGGGCCACTAGGGACAGGAT (SEQ ID NO: 1301)). The gRNAs used in this Example comprise the following spacer sequences: AAVS1 gRNA spacer (GGGGCCACUAGGGACAGGAU (SEQ ID NO: 1308)); TRAC gRNA spacer (AGAGCAACAGUGCUGUGGCC (SEQ ID NO: 152)); and B2M gRNA spacer (GCUACUCUCUCUUUCUGGCC (SEQ ID NO: 466)).

Figure 17A:
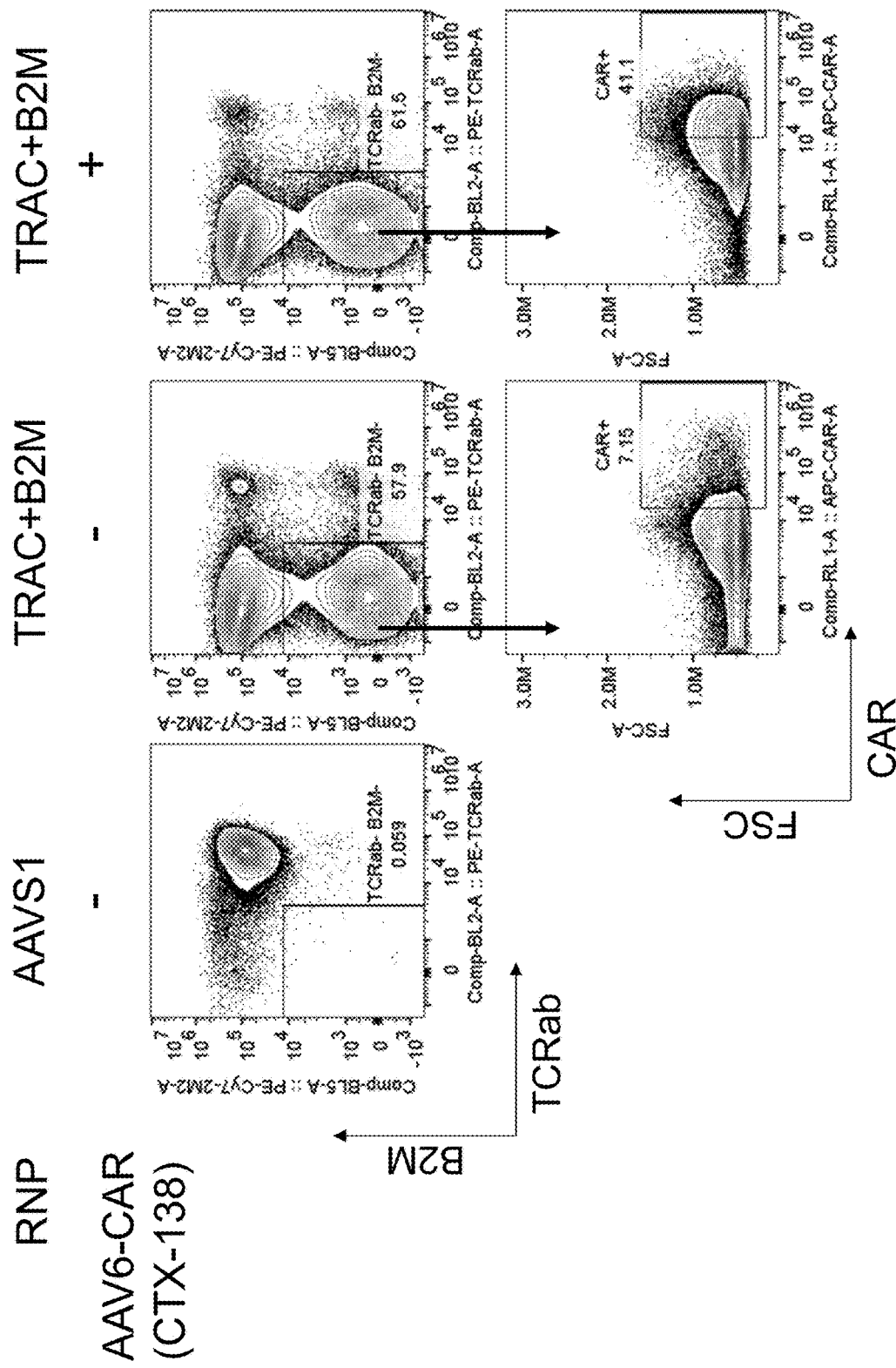
FIG. 17A is a series of flow cytometry plots demonstrating that single cells express a CAR construct and lack surface expression of the TCR and B2M only when the cells have been treated with RNPs to TRAC and B2M and have been infected with a vector that delivers a donor template containing a CAR construct flanked by homologous sequence to the TRAC locus mediated site specific integration and expression of the CAR construct.
Figure 17B:
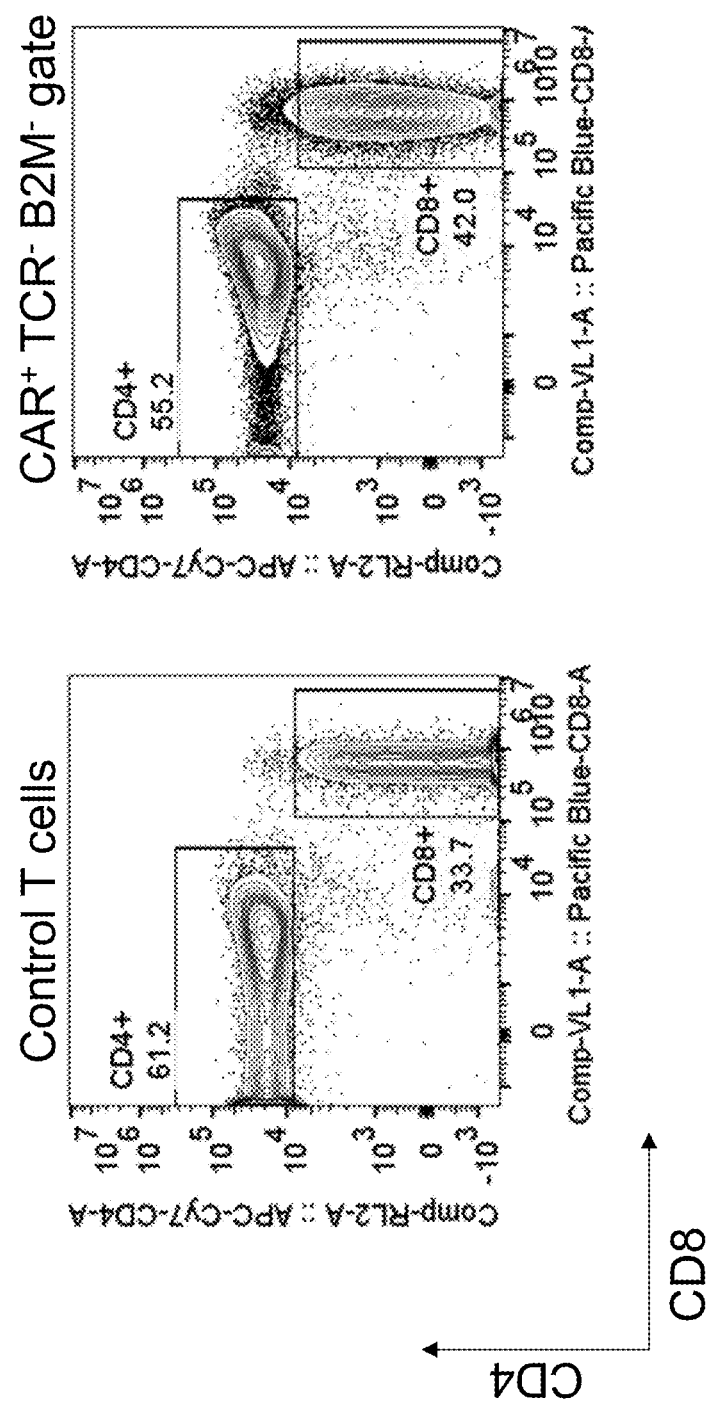
FIG. 17B is a series flow cytometry plots demonstrating normal proportions of CD4 and CD8 T cells that are CAR$^+$TCR$^-$B2M$^-$.

T cell staining was performed as described above in Example 3 with a modification in which the cells were stained with anti-mouse Fab2 antibody labeled with biotin (115-065-006, Jackson ImmunoRes) at a dilution of 1:5 for 30 minutes at 4° C. The cells were then washed and stained with a streptavidin conjugate. The flow cytometry results are shown in FIGS. 17A & 17B.

The ability of the engineered cells to lyse Raji lymphoma cells and to produce interferon gamma (IFNg or IFNγ) was then analyzed using a cell kill assay and ELISA. Briefly, the cell kill assay and ELISA were performed using black walled 96 well plates, 100 ug Staurosporine (Fisher 1285100U), Cell Stimulation Cocktail (PMA) (Fisher 501129036), Trypan Blue (Fisher 15250061), PBS, and Raji media (10% Heat-Inactivated Fetal Bovine Serum (Sigma F4135-500ML, 15L115)) and RPMI 1640 (Life Technologies 61870036)) or K562 Media (10% Heat-Inactivated Fetal Bovine Serum (Sigma F4135-500ML, 15L115) and IMDM (Life Technologies 12440061).

T-cells and CAR-T samples were re-suspended in the appropriate RPMI/10% FBS to a dilution of 4.0×10$^5$/100 μL, and Luciferase expressing cells were re-suspended at 1.0×10$^5$/100 uL. After re-suspension, all samples were plated at a final volume of 200 uL per well as shown. Plates were incubated overnight, and after 24 hours, plates were spun down for 10 minutes. Thirty (30) μL of the top supernatant media was collected for use in the IFNγ ELISA (RD Systems SIF50) on a new plate. The remaining plate volume was then used in the Luciferase Assay (Perkin Elmer 6RT0665).

Figure 16A:
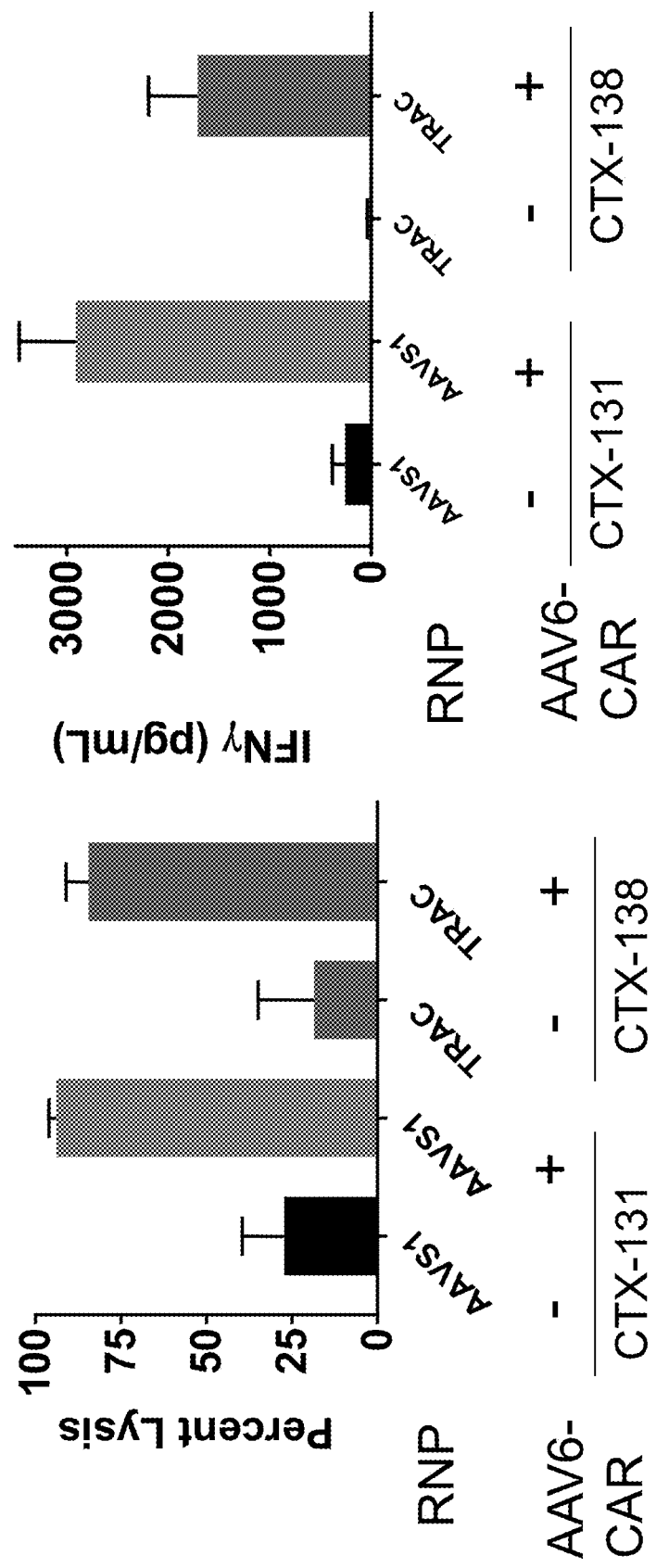
FIG. 16A is a series of graphs depicting the ability of T cells expressing an anti-CD19 CAR construct inserted into the AAVS1 locus (AAVS1 RNP+CTX131) or the TRAC locus (TRAC RNP+CTX-138) to lyse the Raji lymphoma cells in a co-culture assay (Left panel) and to produce Interferon gamma (IFNg or IFNγ) in the presence of Raji lymphoma cells (right panel).
Figure 16B:
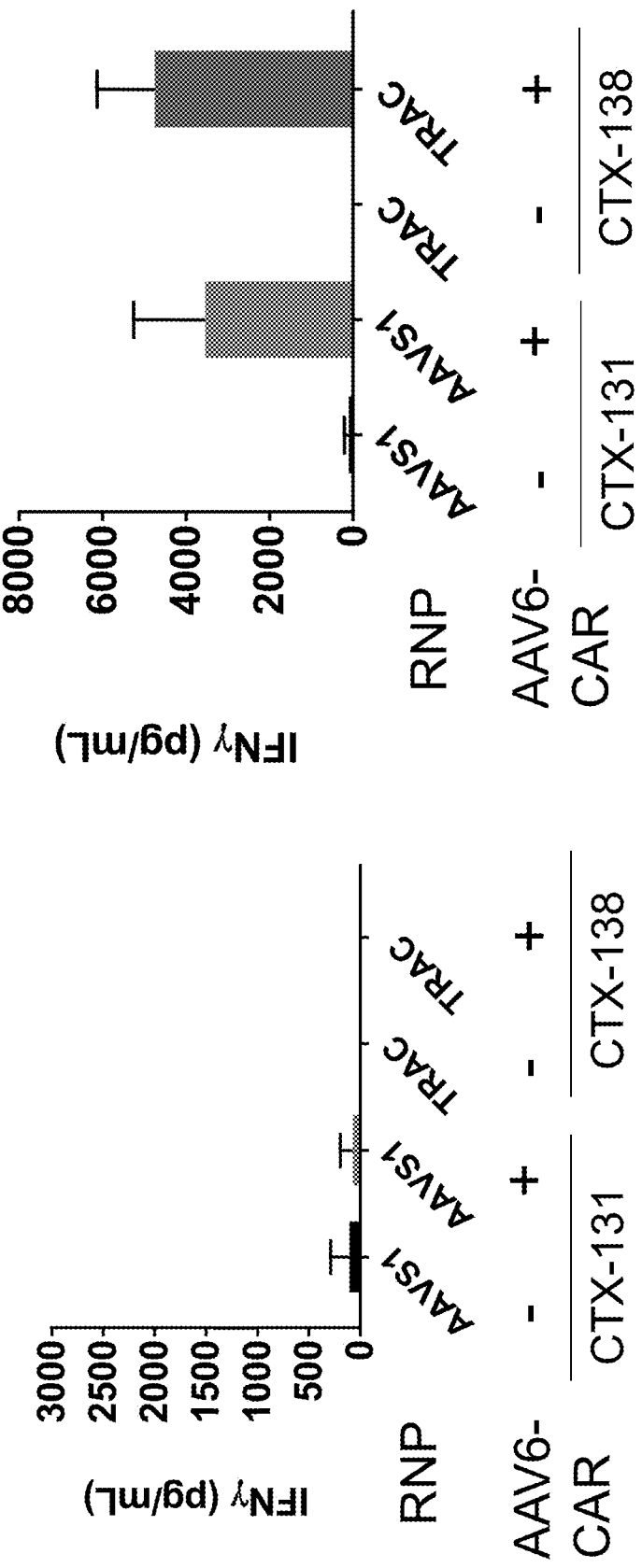
FIG. 16B is a series of graphs demonstrating a lack of interferon gamma (IFNg) production in the presence of anti-CD19 CAR-T cells generated by CRISPR/AAV co-cultured with K562 cells (left panel). IFNg production levels increase in the presence of CAR-T expressing anti-CD19 CAR from either the AAVS1 locus (AAVS1 RNP+CTX131) or the TRAC locus (TRAC RNP+CTX-138) when co-cultured with K562 cells that have been designed to over-express CD19 (right panel).

T cells expressing an anti-CD19 CAR construct either from the AAVS1 locus (AAVS1 RNP+CTX-131) or from the TRAC locus (TRAC RNP+CTX-138) were able to lyse the Raji lymphoma cells in a coculture assay (FIG. 16A, left panel). The CAR-T cells, but not CAR negative controls, were able to produce Interferon gamma (IFNγ or IFNg) in the presence of Raji lymphoma cells (FIG. 16A, right panel). Anti-CD19 CAR-T cells generated by CRISPR/AAV did not produce IFNγ when cocultured with K562 cells, a cell line negative for CD19 expression. When K562 were produced to overexpress CD19, and cocultured with CAR-T cells expressing anti-CD19 CAR from either from the AAVS1 locus (AAVS1 RNP+CTX-131) or from the TRAC locus (TRAC RNP+CTX-138), the CAR-T expressing cells induced IFNγ production. FIG. 16B (left panel) show that CAR-T cells expressing anti-CD19 CAR do not induce IFNγ in K562 cells lacking CD19. However, IFNγ levels of CAR-T cells expressing anti-CD19 CAR are stimulated in K562 cells expressing CD19 (FIG. 16B, right panel).

Figure 17C:
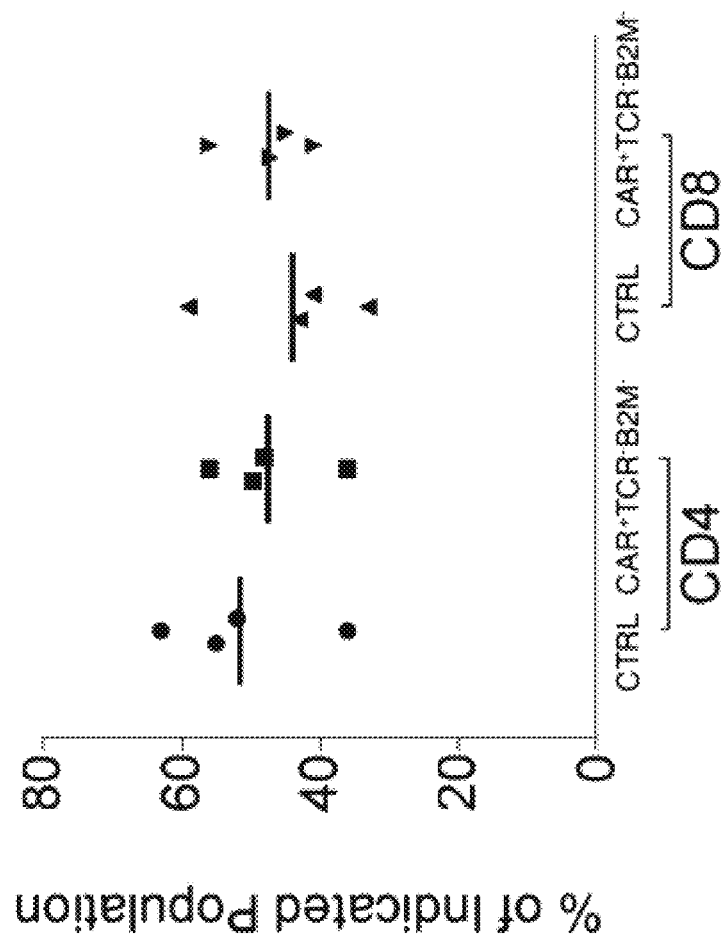
FIG. 17C is a dot plot summarizing the proportions of CD4 and CD8 expression in replicates of the flow cytometry experiment in FIG. 17B. Four replicates of CAR$^+$TCR$^-$B2M$^-$ and four Control replicates were analyzed. CD4 and CD8 frequencies remain unchanged in the production of CAR$^+$TCR$^-$B2M$^-$ T cells compared to controls.
Figure 17D:
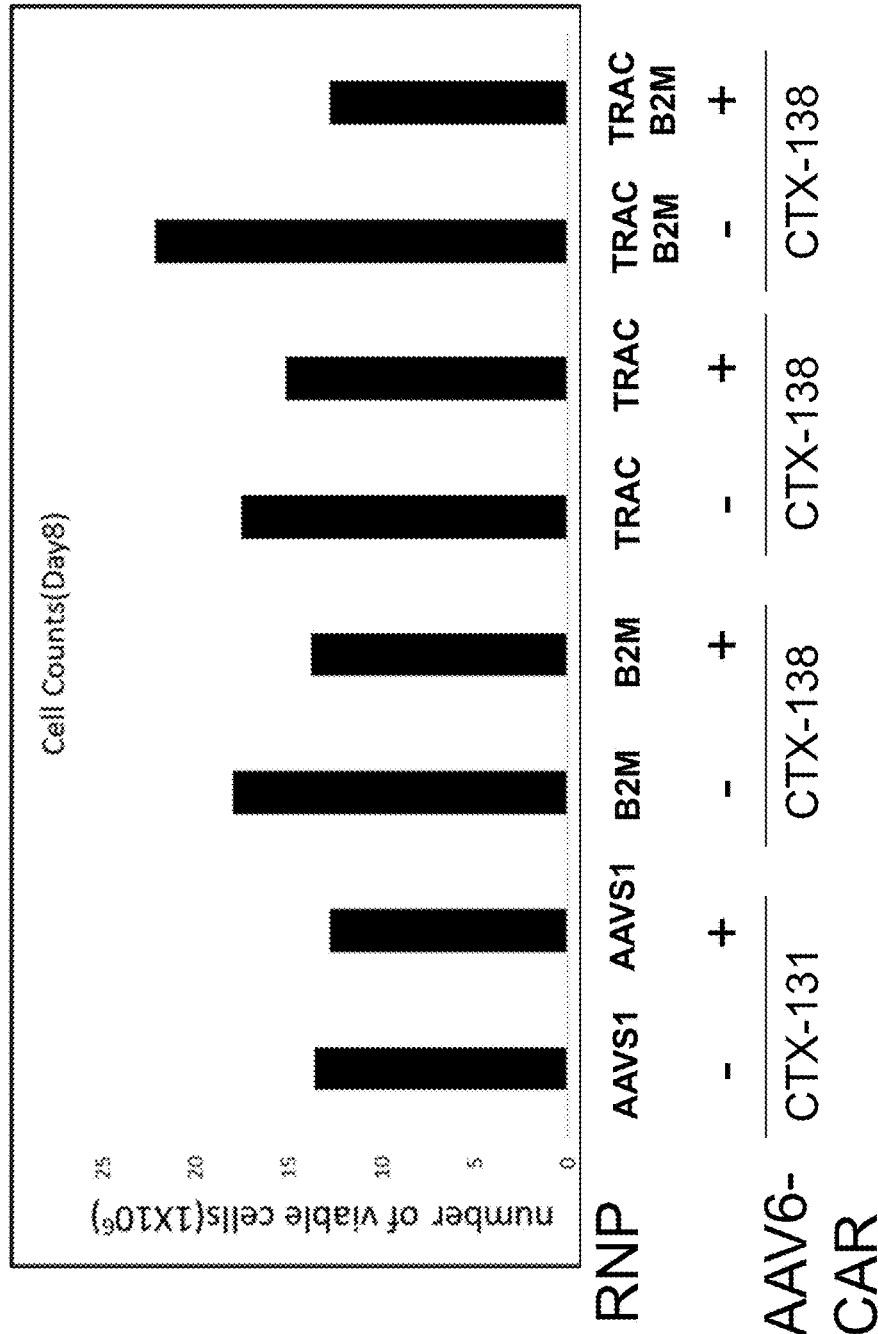
FIG. 17D is a graph depicting the number of viable cells enumerated 8 days post electroporation and AAV6 infection.

FIG. 17A demonstrates that single cells engineered to express a CAR construct and to lack surface expression of TCR and B2M did so only when the cells were treated with RNPs to TRAC and B2M and infected with AAV6 (CTX-138) that delivers a donor template containing a CAR construct flanked by homologous sequence to the TRAC locus mediated site specific integration and expression of the CAR construct. Normal proportions of CD4 and CD8 T cells that were CAR⁺TCR⁻B2M⁻ were observed, as shown in FIG. 17B and FIG. 17C. The engineered cells remained viable 8 days post electroporation and AAV6 infection, as shown in FIG. 17D.

Figure 18A:
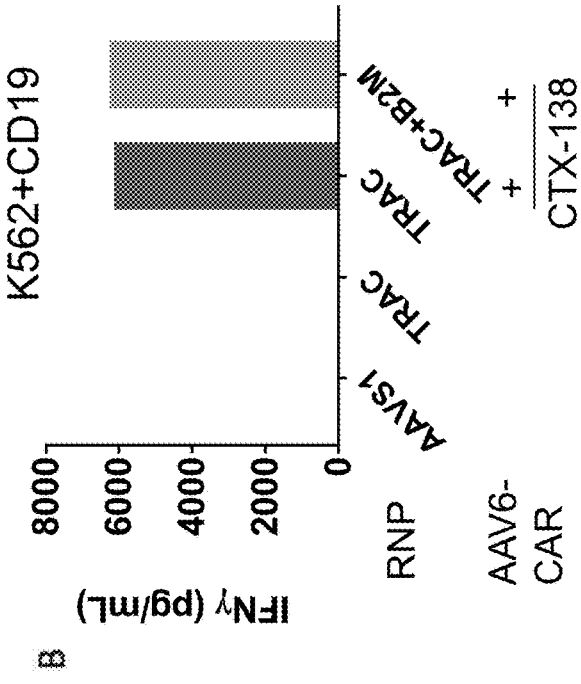
FIG. 18A is a graph demonstrating lack of IFNg production in co-cultures of K562 and the indicated cells.
Figure 18B:
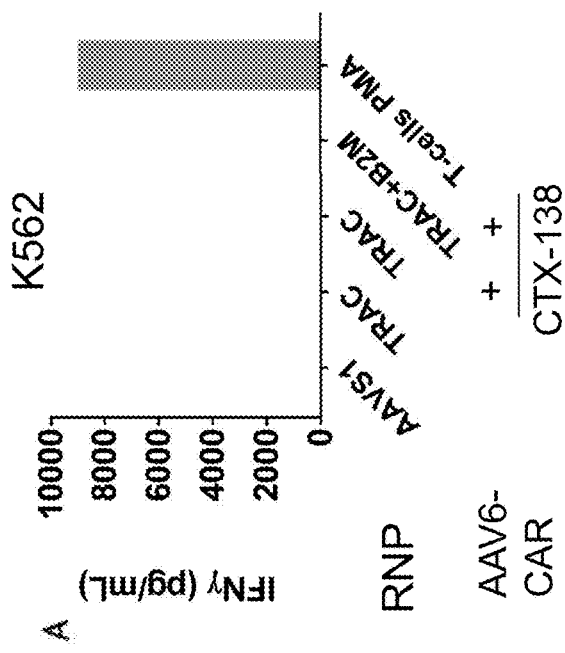
FIG. 18B is a graph demonstrating increased production of IFNg only in cells made to express an anti-CD19 CAR integrated in the TRAC locus with or without knockout of B2M when T cells were co-cultured with CD19-expressing K562 cells.
Figure 18C:
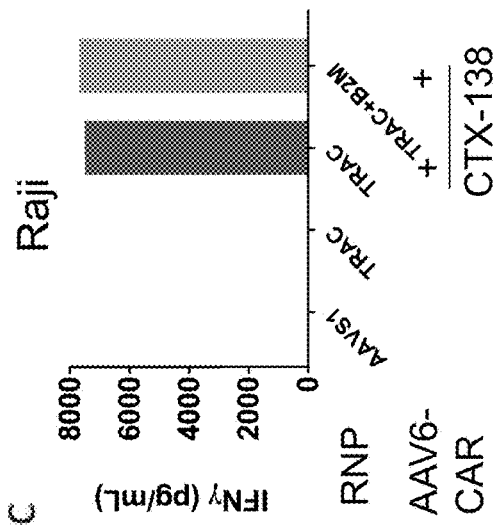
FIG. 18C is a graph demonstrating increased IFNg production in co-cultures of CD19+ Raji lymphoma cell line and T cells treated as indicated.

FIGS. 18A and 18B demonstrate that the engineered cells produced and increased level of production of interferon gamma (IFNg or IFNγ) only in cells made to express an anti-CD19 CAR integrated in the TRAC locus with or without knockout of B2M when T cells were cocultured with CD19-expressing K562 cells. FIG. 18C demonstrates increased IFNγ production in co-cultures of CD19+ Raji lymphoma cell line and T cells treated as indicated.

CAR Expression Using rAAV Constructs with Different TRAC sgRNAs

This example describes the effect of donor design and guide selection on CAR expression in allogeneic human T cells that lack expression of TCR and MHC I, and express a chimeric antigen receptor. Cells were prepared using the following sgRNAs: TRAC gRNA spacer "EXON1_T32": AGAGCAACAGUGCUGUGGCC (SEQ ID NO: 152); sgRNA (SEQ ID NO: 1345); TRAC gRNA spacer "Exon1_T7" (GAGAAUCAAAAUCGGUGAAU (SEQ ID NO: 88); sgRNA (SEQ ID NO: 1588), and rAAV constructs show in the table below.

The homology arms used in AAV constructs can be designed to more efficiently pair with gRNAs and/or induce a deletion or mutation in the targeted gene locus (e.g.: TRAC locus) following transgene insertion. For example, the homology arms can be designed to flank one or more spacer sequences that results in the deletion of the spacer sequence (s) following transgene insertion by HDR (e.g.: CTX-138). Alternatively, homology arms can be designed with alterations in the TRAC sequence that result in base pair changes, generating mutations in the PAM or spacer sequences. Specific guide design, paired with a particular guide RNA can improve CAR expression.

TABLE 12.1

Construct design and effect of transgene insertion on TRAC gene

| Donor template (LHA-RHA) | SEQ ID NO: | LHA (bp) | LHA SEQ ID NO: | RHA (bp) | RHA SEQ ID NO: |
|---|---|---|---|---|---|
| CTX-138 | 1354 | 800 | 1325 | 800 | 1326 |
| CTX-139 | 1355 | 678 | 1324 | 800 | 1326 |
| CTX-139.1 | 1583 | 800 | 1578 | 800 | 1326 |

TABLE 12.1-continued

Construct design and effect of transgene insertion on TRAC gene

| Donor template (LHA-RHA) | SEQ ID NO: | LHA (bp) | LHA SEQ ID NO: | RHA (bp) | RHA SEQ ID NO: |
|---|---|---|---|---|---|
| CTX-139.2 | 1584 | 820 | 1579 | 905 | 1580 |
| CTX-139.3 | 1585 | 841 | 1581 | 925 | 1582 |

TABLE 12.1A

CAR expression following transgene insertion

| Donor template (LHA-RHA) | Effect of HDR on TRAC locus | Guide: EXON1_T32 SEQ ID NO: | Guide: EXON1_T7 SEQ ID NO: |
|---|---|---|---|
| CTX-138 | 20 bp deletion spanning Exon1_T32 target sequence | 55% | 9.5% |
| CTX-139 | 141 bp deletion spanning Exon1_T32 & Exon1_T7 target sequence | 54% | 30% |
| CTX-139.1 | 141 bp deletion spanning Exon1_T32 & Exon1_T7 target sequence | n.a. | 19% |
| CTX-139.2 | 20 bp deletion spanning Exon1_T7 target sequence | n.a. | 50% |
| CTX-139.3 | 0 bp deletion; mutates PAM sequence 3' of Exon1_T7 target sequence; (1 nucleotide change in PAM) | n.a. | 54% |

Example 10—Analysis of On-Target Indel Profiles in T Cells

On-target amplicon analysis was conducted the TRAC and B2M locus following gene editing using the following guides:

```
                           (SEQ ID NO: 466)
B2M spacer:   GCUACUCUCUCUUUCUGGCC; sgRNA (SEQ ID
              NO: 1343
                                  (SEQ ID NO: 152)
TRAC spacer:  AGAGCAACAGUGCUGUGGCC; sgRNA (SEQ ID
              NO: 1345)
```

Following gene editing, on-target amplicon analysis was conducted around the TRAC and B2M locus in TRAC−/B2M−/anti-CD19 CAR+ cells.

An initial PCR was performed using the 2× Kapa HiFi Hotstart Mastermix (Kapa Biosystems, Wilmington, Mass.). 50 ng of input gDNA was combined with 300 nM of each primer. The TRAC_F and TRAC_R primers were paired for the TRAC locus, and the B2M_F and B2M_R primers were paired to amplify the B2M locus (Table ##).

TABLE 12.2

Primers for TRAC and B2M amplicon library preparation

| TRAC_F | TCGTCGGCAGCGTCAGATGTGTATAAGAGACAGcgtgtaccagctgagagact |
| TRAC_R | GTCTCGTGGGCTCGGAGATGTGTATAAGAGACAGatgctgttgttgaaggcgtt |
| B2M_F | TCGTCGGCAGCGTCAGATGTGTATAAGAGACAGgggcattcctgaagctgaca |
| B2M_R | GTCTCGTGGGCTCGGAGATGTGTATAAGAGACAGttggagaagggaagtcacgg |

Analysis of the B2M locus in a population of T cells following gene editing to produce TRAC−/B2M−/CAR+ T cells results in the following indel frequencies and edited gene sequences at the B2M locus (deletions as dashes and insertions in bold).

TABLE 12.3

| SEQ ID NO: | Gene edited sequence | Frequency |
|---|---|---|
| 1560 | CGTGGCCTTAGCTGTGCTCGCGCTACTCTCTCTTTCT-GCCTGGAGGCTATCCAGCGTGAGTCTCTCCTACCCTCCCGCT | 16.2% |
| 1561 | CGTGGCCTTAGCTGTGCTCGCGCTACTCTCTCTTTC--GCCTGGAGGCTATCCAGCGTGAGTCTCTCCTACCCTCCCGCT | 6.3% |
| 1562 | CGTGGCCTTAGCTGTGCTCGCGCTACTCTCTCTTT-----CTGGAGGCTATCCAGCGTGAGTCTCTCCTACCCTCCCGCT | 4.7% |
| 1563 | CGTGGCCTTAGCTGTGCTCGCGCTACTCTCTCTTTCTGGATAGCCTGGAGGCTATCCAGCGTGAGTCTCTCCTACCCTCCCGCT | 2.2% |
| 1564 | CGTGGCCTTAGCTGTGCTCGC--------------------------GCTATCCAGCGTGAGTCTCTCCTACCCTCCCGCT | 2.1% |
| 1565 | CGTGGCCTTAGCTGTGCTCGCGCTACTCTCTCTTTCTGTGGCCTGGAGGCTATCCAGCGTGAGTCTCTCCTACCCTCCCGCT | 2.1% |

Analysis of the TRAC locus in a population of T cells following gene editing to produce TRAC−/B2M−/CAR+ T cells results in the following indel frequencies and edited gene sequences at the TRAC locus in T cells without a CAR insertion (deletions as dashes and insertions in bold).

TABLE 12.4

| SEQ ID NO: | Gene edited sequence | Frequency |
|---|---|---|
| 1566 | AA--------------------GAGCAACAAATCTGACT | 16.4% |
| 1567 | AAGAGCAACAGTGCTGT-GCCTGGAGCAACAAATCTGACT | 16.0% |
| 1568 | AAGAGCAACAGTG-------CTGGAGCAACAAATCTGACT | 7.5% |
| 1569 | AAGAGCAACAGT------GCCTGGAGCAACAAATCTGACT | 7.0% |
| 1570 | AAGAGCAACAGTG--------------------CTGACT | 1.6% |
| 1571 | AAGAGCAACAGTGCTGTGGGCCTGGAGCAACAAATCTGACT | 2.5% |
| 1572 | AAGAGCAACAGTGC--TGGCCTGGAGCAACAAATCTGACT | 2.2% |
| 1573 | AAGAGCAACAGTGCTGTGTGCCTGGAGCAACAAATCTGACT | 2.0% |

Example 11—Production of Site-Specific Allogeneic CD19 CAR-T Cells by CRISPR-Cas9 for B-Cell Malignancies CRISPR/Cas9 technologies have been applied to develop anti CD19 allogeneic chimeric antigen receptor T cells (CAR-T) with reduced potential for graft vs. host disease (GVHD), and reduced rejection potential for the treatment of CD19 positive malignancies. The efficiency of the CRISPR/Cas9 system enables rapid production of homogeneous CAR-T product from prescreened healthy donors and thus can potentially be developed as an "off-the-shelf" therapy for efficient delivery to patients. Autologous CAR-T therapeutics targeting CD19 have shown impressive responses in B-cell malignancies but currently require significant individualized manufacturing efforts and can suffer from manufacturing failures. In addition, these autologous CAR-Ts are produced using retrovirus or lentivirus, for which the variable nature of integration can lead to a heterogeneous product. Allogeneic or "off-the-shelf" CAR-T products with site-specific CAR integration generated with gene editing technologies may address some of these significant challenges seen for autologous products.

CRISPR-Cas9 technology was utilized in primary human T cells to produce allogeneic CAR-T cells by multiplexed genome editing. A robust system for site-specific integration of CAR and concurrent multiplexed gene editing in single T cells has been developed by utilizing homology-directed repair (HDR) with Cas9 ribonucleoprotein (RNP) and an AAV6-delivered donor template.

With CRISPR/Cas9 editing technology, high frequency knockout of the constant region of the TCRα gene (TRAC) with ~98% reduction of TCR surface expression in human primary T-cells from healthy donors, which aims to significantly impair graft-versus-host disease (GVHD), was achieved. High frequency knockout of the β-2-microglobulin (B2M) gene could also be obtained, which aims to increase persistence in patients, potentially leading to increased potency overall. TRAC/B2M double knockout frequencies have been obtained in ~80% of T cells without any subsequent antibody-based purification or enrichment. Human T cells expressing a CD19-specific CAR from within a disrupted TRAC locus, produced by homology-directed repair using an AAV6-delivered donor template, along with knockout of the B2M gene have been consistently produced at a high efficiency. This site-specific integration of the CAR protects against the potential outgrowth of CD3$^+$CAR$^+$ cells, further reducing the risk of GVHD, while also reducing the risk of insertional mutagenesis associated with retroviral or lentiviral delivery mechanisms. These engineered allogeneic CAR-T cells show CD19-dependent T-cell cytokine secretion and potent CD19-specific cancer cell lysis.

Figure 23:
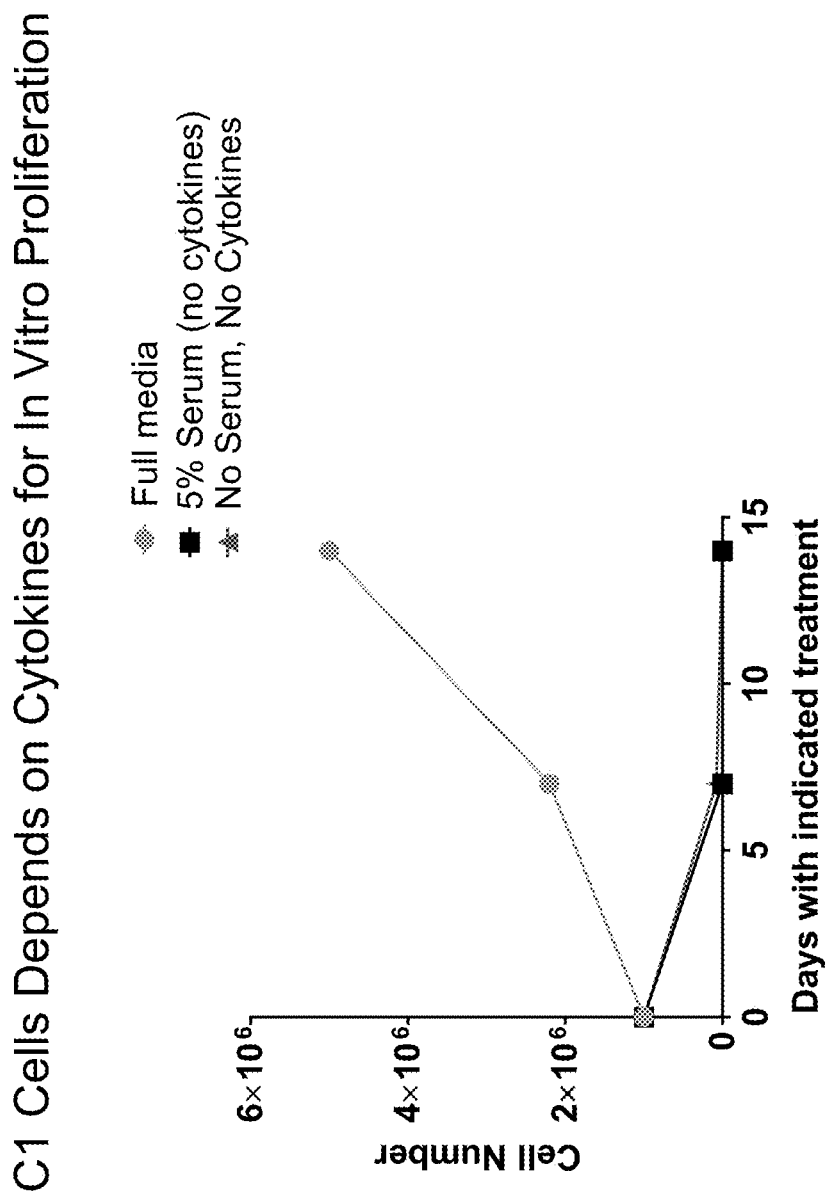
FIG. 23 is a graph demonstrating that TC1 cells do not exhibit cytokine independent growth in vitro.
Figure 39:
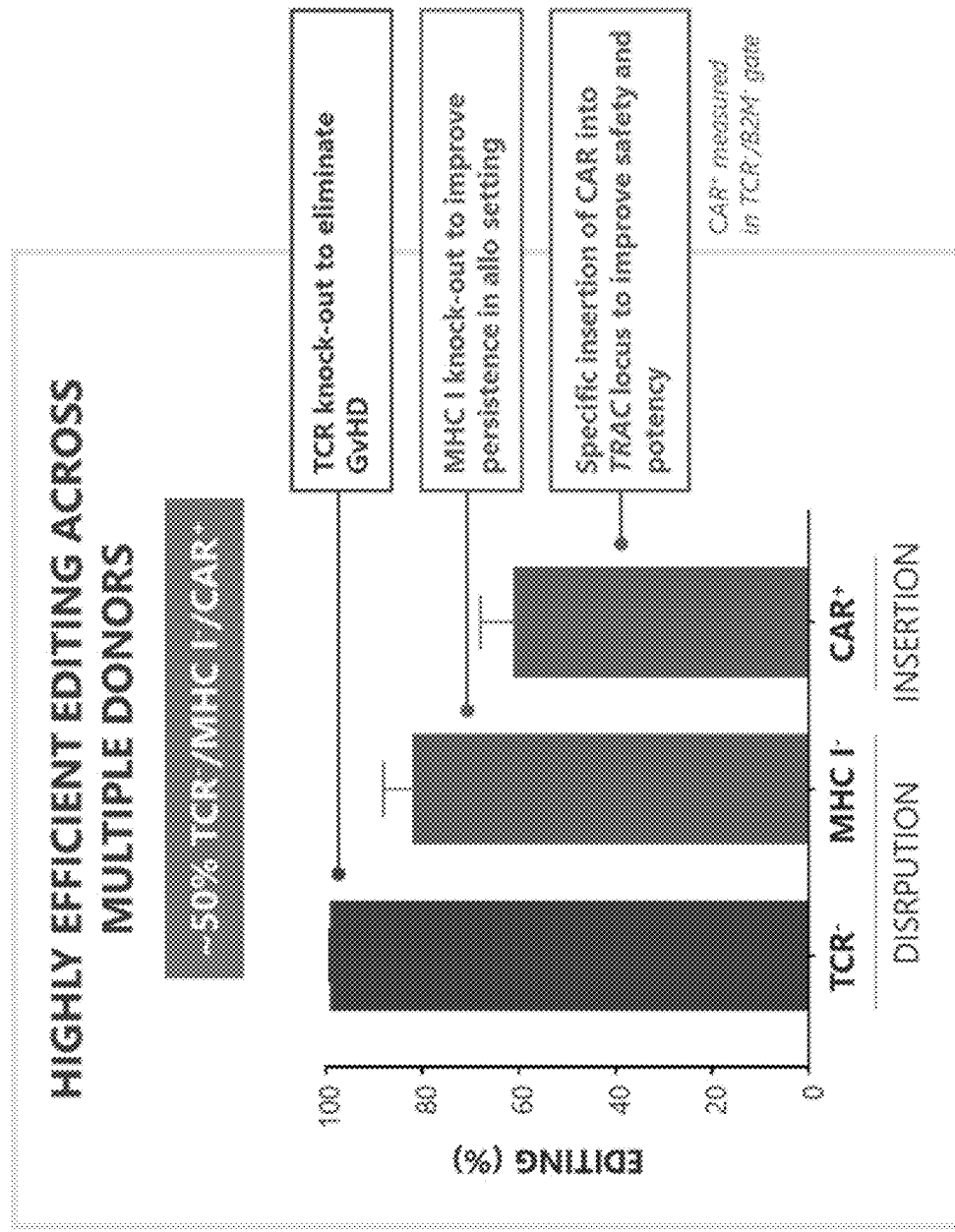
FIG. 39 is a graph depicting high editing rates achieved at the TRAC and B2M loci in TRAC−/B2M−CD19CAR+T cells (TC1). Surface expression of TCR and MHCI, which is the functional output of gene editing, was measured and plotted as editing percentage on the y-axis. High efficiency (e.g., greater than 50%) site-specific integration and expression of the CAR from the TRAC locus were detected. These data demonstrate greater than 50% efficiciency for the generation of TRAC−/B2M−/anti-CD19CAR+T cells.
Figure 40:
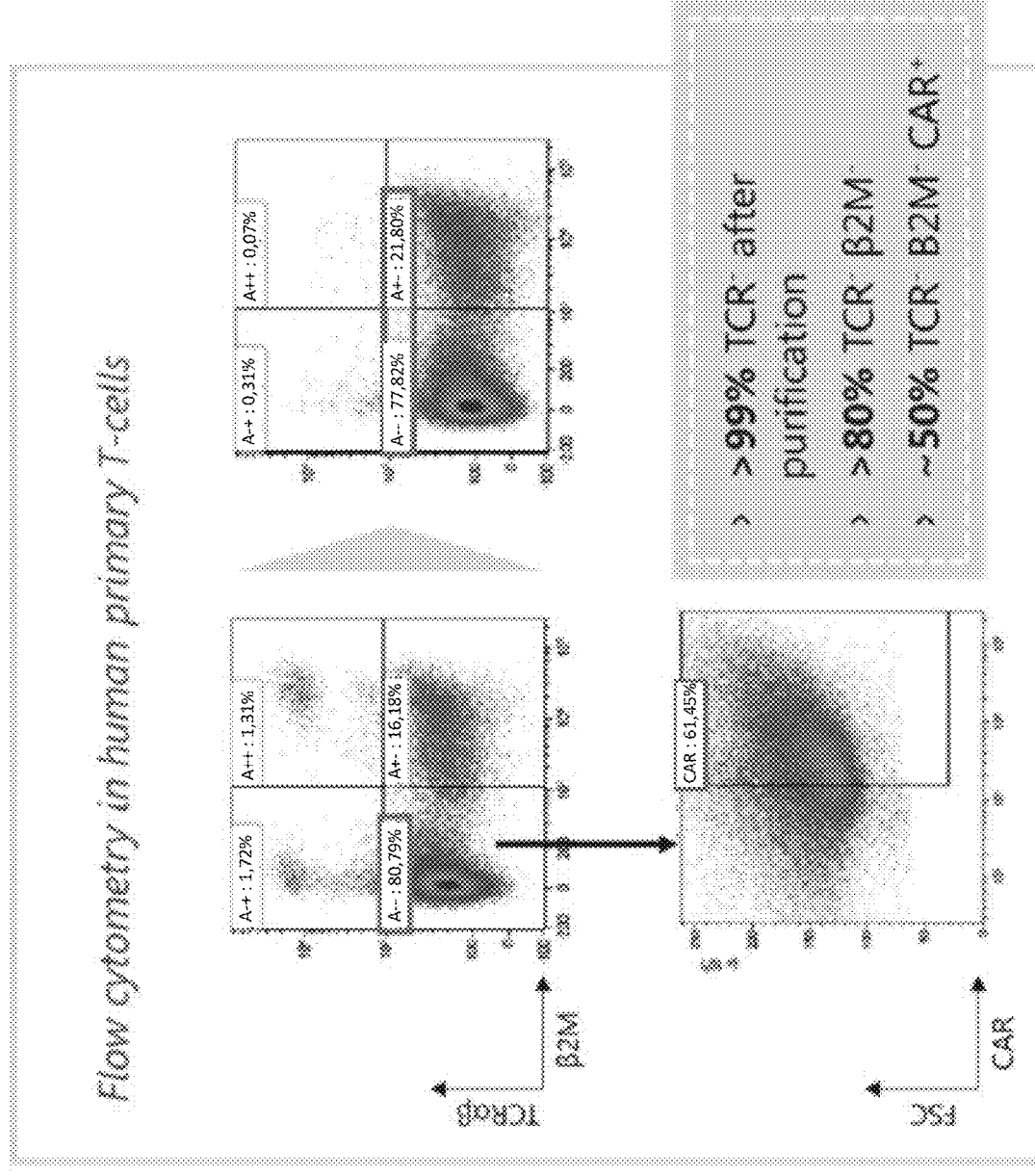
FIG. 40 is a series of flow cytometry plots of human primary T-cells, TRAC−/B2M− CD19CAR+T cells (TC1), 8 days post-editing. The graphs show reduced surface expression of TRAC and B2M. TCR/MHC I double knockout cells express high levels of the CAR transgene (bottom panel). Negative selection of TC1 cells with purification beads leads to a reduction in TCR positive cells (right panel).
Figure 41:
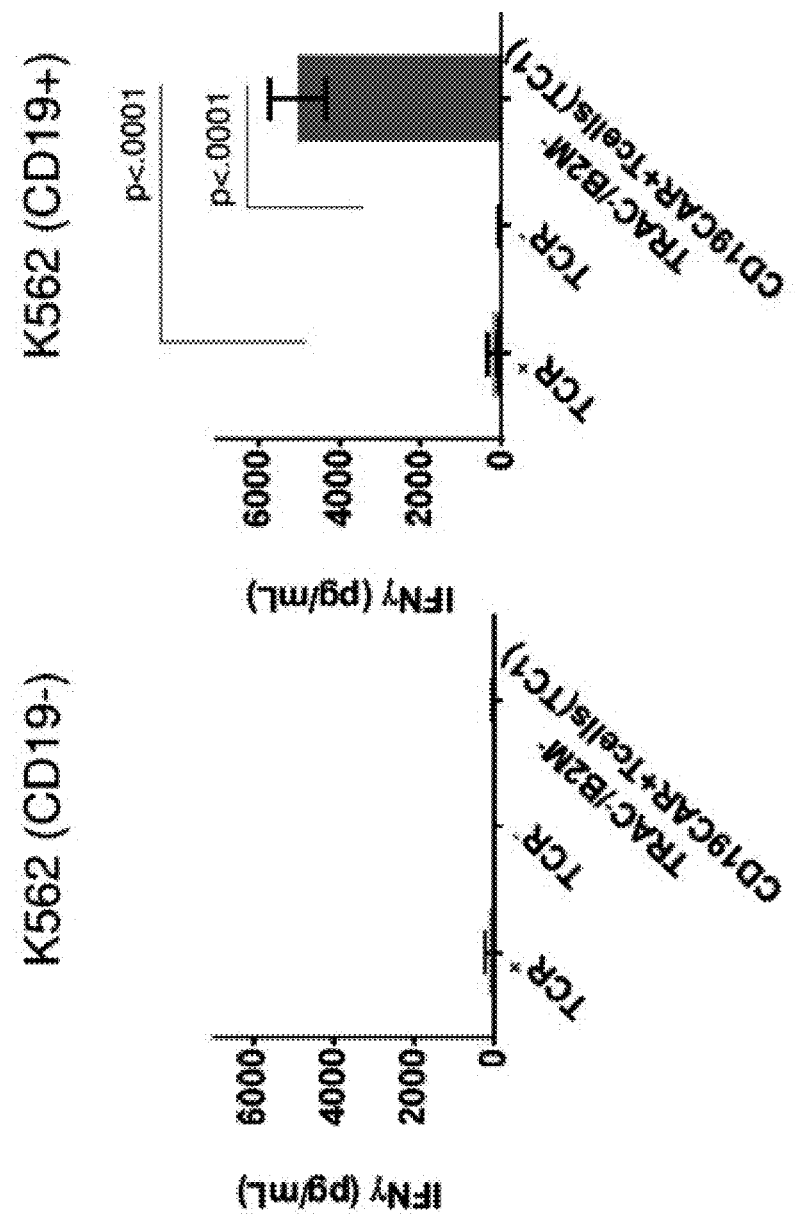
FIG. 41 is a graph demonstrating a statistically significant increase in production of IFNγ in TRAC−/B2M− CD19CAR+ T cells (TC1) when co-cultured with CD19-expressing K562 cells but not when co-cultured with K562 cells that lack the expression of CD19. This experiment was performed in triplicate according to the method in FIG. 18B. Statistical analysis was performed with ANOVA using Tukey's multiple comparisons test.

We are able to use genome editing with the CRISPR-Cas9 system to efficiently create an allogeneic or "off-the-shelf" CAR-T cell product (e.g.: TC1) that demonstrates potent and specific anticancer effects for patients with CD19-expressing human cancers. More specifically, and as demonstrated herein the production of allogeneic anti-CD19 CAR-T product (FIG. 40) that exhibits high efficiency editing (e.g., greater than 50% TRAC$^-$/B2M$^-$/anti-CD19CAR+T cells eficiciency) (FIG. 39), CD19-specific effector functions (FIG. 35 and FIG. 41), kills CD19$^+$ leukemia or lymphoma cells in vitro and in vivo (FIG. 35 and FIG. 42), and does not proliferate in the absence of cytokines (FIG. 23). In addition, the off-target profile is consistent with results from other gene-edited T cell therapeutics in development.

Example 12—Dose Escalation Study to Determine the Efficacy of CAR-T Cells in the Subcutaneous Raji Human Burkett's Lymphoma Tumor Xenograft Model in NOG Mice In this example, the efficacy of CAR-T cells against the subcutaneous Raji Human Burkett's Lymphoma tumor xenograft model in NOG mice was evaluated. Transgene insertion in primary human T cells via homology directed repair (HDR) and concurrent gene knockout by Cas9:sgRNA RNA was performed as described above in Examples 8-10 to produce cells lacking TCR and B2M surface expression and to concurrently express an anti-CD19 CAR construct (TRAC$^-$/B2M$^-$CD19CAR+ cells). Primary human T cells were first electroporated with Cas9 or Cas9:sgRNA RNP complexes targeting TRAC (AGAGCAACAGTGCTGTGGCC (SEQ ID NO: 76) and B2M1 (GCTACTCTCTCTTTCTGGCC (SEQ ID NO: 417)). The DNA double stranded break at the TRAC locus was repaired by homology directed repair with an AAV6-delivered DNA template (CTX-138; SEQ ID NO: 675) containing right and left homology arms to the TRAC locus flanking a chimeric antigen receptor cassette (−/+ regulatory elements for gene expression). The resulting modified T cells (TC1) are TRAC$^-$/B2M$^-$CD19CAR+. The ability of the modified TRAC$^-$/B2M$^-$CD19CAR+ T cells to ameleriote disease caused by a CD19+ lymphoma cell line (Raji) was evaluated in NOG mice using methods employed by Translational Drug Development, LLC (Scottsdale, Ariz.). In brief, 12, 5-8 week old female, CIEA NOG (NOD.Cg-Prkdc$^{scid}$I12rg$^{tm1Sug}$/JicTac) mice were individually housed in ventilated microisolator cages, maintained under pathogen-free conditions, 5-7 days prior to the start of the study. On Day 1 mice received a subcutaneous inoculation of 5×10$^6$ Raji cells/mouse. The mice were further divided into 3 treatment groups as shown in Table 13. On Day 8 (7 days post inoculation with the Raji cells), treatment group 2 and group 3 received a single 200 μl intravenous dose of TRAC$^-$/B2M$^-$CD19CAR+cells (TC1) according to Table 13. The gRNAs used in this Example comprise the following spacer sequences:

TRAC gRNA spacer (AGAGCAACAGUGCUGUGGCC); (SEQ ID NO: 152)

and

B2M gRNA spacer (GCUACUCUCUCUUUCUGGCC). (SEQ ID NO: 466)

TABLE 13

Treatment groups

| Group | Raji Cells (s.c.) | TC1 Treatment (i.v.) | N |
|---|---|---|---|
| 1 | 5 × 10⁶ cells/mouse | None | 4 |
| 2 | 5 × 10⁶ cells/mouse | 5 × 10⁶ cells/mouse | 4 |
| 3 | 5 × 10⁶ cells/mouse | 1 × 10⁷ cells/mouse | 4 |

Tumor volume and body weight was measured and individual mice were euthanized when tumor volume was ≥500 mm³.

Figure 19:
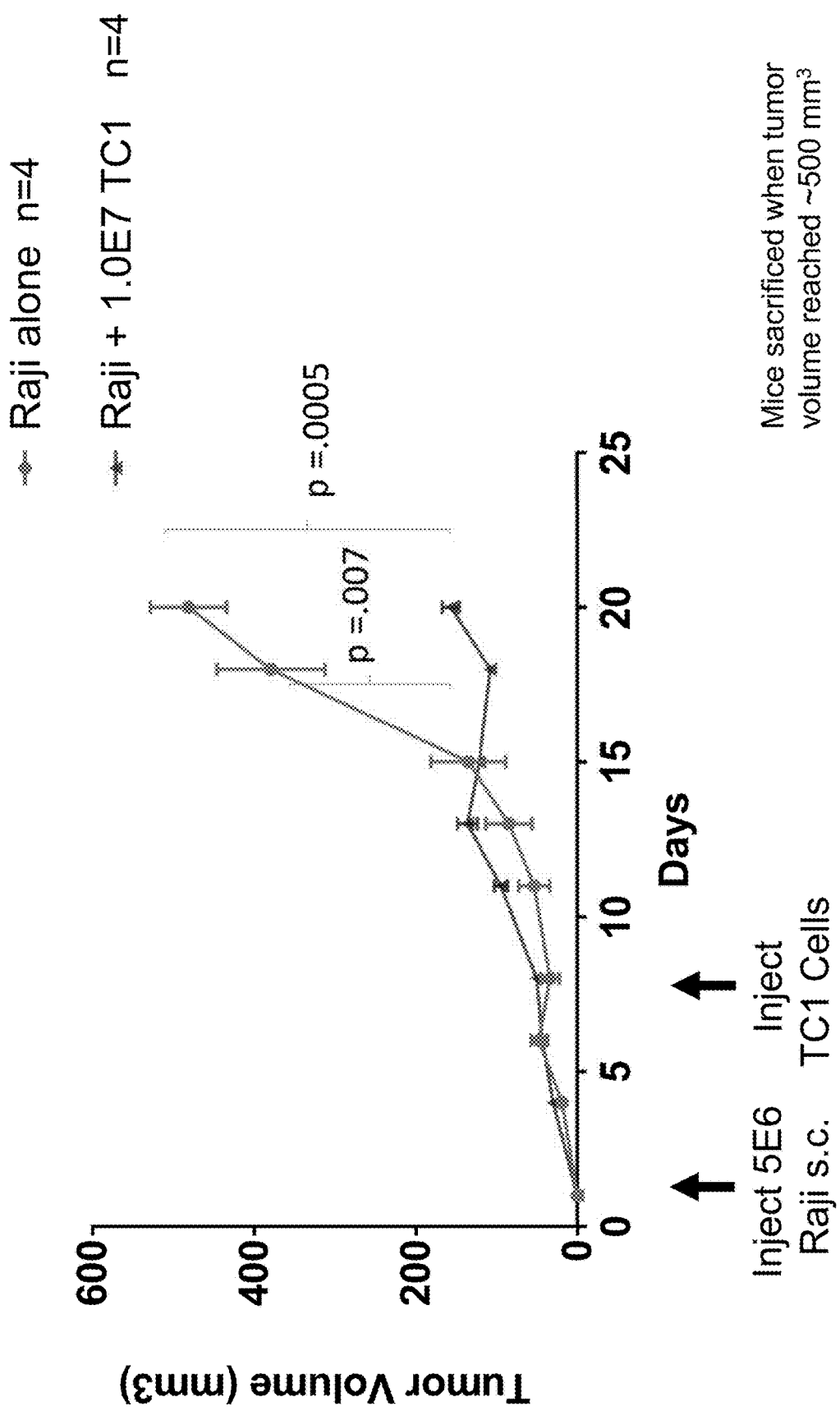
FIG. 19 is a graph depicting a statistically significant decrease in tumor volume ($mm^3$) (p=0.007) in NOG Raji mice following treatment with TC1 cells.

By Day 18, the data show a statistically significant decrease in the tumor volume in response to TC1 cells as compared to untreated mice (FIG. 19). The effect on tumor volume was dose-dependent (Table 14); mice receiving higher doses of TC1 cells showed significantly reduced tumor volume when compared to mice receiving either a lower dose of TC1 cells or no treatment. An increase in survival was also observed in the treated group (Table 14).

TABLE 14

Tumor response and survival

| Group | Tumor volume (Day 18) | Tumor volume (Day 20) | Survival (Days) | N |
|---|---|---|---|---|
| 1 | 379.6 ± 67.10 | 482 ± 47.37 | 20-22 | 4 |
| 2 | 214.0 ± 20.73 | 372.2 ± 78.21 | 25 | 4 |
| 3 | 107.5 ± 7.33* | 157.1 ± 10.62** | 27 (end of study) | 4 |

*p = 0.007 compared to control (Group 1)
**p = 0.0005 compared to control (Group 1)

In addition to CT1 described above, additional modified T cells expressing a chimeric antigen receptor (CAR) comprising an extracellular domain comprising an anti-CD19 scFv and further comprising a double knock-out of the TRAC and B2M genes are contemplated for use this and other examples described herein. In certain embodiments the TRAC⁻/B2M⁻CD19CAR+ cells, the TRAC deletion may be accomplished using any one of the TRAC spacer sequences described herein. In certain embodiments of the TRAC⁻/B2M⁻CD19CAR+ cells, the β2M deletion may be accomplished using any one of the B2M spacer sequences described herein.

Example 13—Assessment of CAR-T Cells Efficacy in Intravenous Disseminated Models in NOG Mice Intravenous Disseminated Raji Human Burkett's Lymphoma Tumor Xenograft Model The Intravenous Disseminated Model (Disseminated Model) using the Raji Human Burkett's Lymphoma tumor cell line in NOG mice was used in this example to further demonstrate the efficacy of TRAC⁻/B2M⁻CD19CAR+ cells. Generation of the TRAC⁻/B2M⁻CD19CAR+ cells (TC1) used in this model was described in the Examples above and evaluated in the Disseminated Model using methods employed by Translations Drug Development, LLC (Scottsdale, Ariz.) and described herein. In brief, 24, 5-8 week old female CIEA NOG (NOD.Cg-Prkdc$^{scid}$Il2rg$^{tm1Sug}$/JicTac) mice were individually housed in ventilated microisolator cages, maintained under pathogen-free conditions, 5-7 days prior to the start of the study. At the start of the study, the mice were divided into 5 treatment groups as shown in Table 15. On Day 1 mice in Groups 2-5 received an intravenous injection of 0.5×10⁶ Raji cells/mouse. The mice were inoculated intravenously to model disseminated disease. On Day 8 (7 days post injection with the Raji cells), treatment Groups 3-5 received a single 200 μl intravenous dose of TC1 cells per Table 15.

TABLE 15

Treatment groups

| Group | Raji Cells (i.v.) | TC1 Treatment (i.v.) | N |
|---|---|---|---|
| 1 | None | None | 8 |
| 2 | 0.5 × 10⁶ cells/mouse | None | 4 |
| 3 | 0.5 × 10⁶ cells/mouse | 1 × 10⁶ cells/mouse (~0.5 × 10⁶ CAR-T+ cells) | 4 |
| 4 | 0.5 × 10⁶ cells/mouse | 2 × 10⁶ cells/mouse (~1.0 × 10⁶ CAR-T+ cells) | 4 |
| 5 | 0.5 × 10⁶ cells/mouse | 4 × 10⁶ cells/mouse (~2.0 × 10⁶ CAR-T+ cells) | 4 |

During the course of the study mice were monitored daily and body weight was measured two times weekly. A significant endpoint was the time to peri-morbidity and the effect of T-cell engraftment was also assessed. The percentage of animal mortality and time to death were recorded for every group in the study. Mice were euthanized prior to reaching a moribund state. Mice may be defined as moribund and sacrificed if one or more of the following criteria were met:

Loss of body weight of 20% or greater sustained for a period of greater than 1 week;

Tumors that inhibit normal physiological function such as eating, drinking, mobility and ability to urinate and or defecate;

Prolonged, excessive diarrhea leading to excessive weight loss (>20%); or

Persistent wheezing and respiratory distress.

Animals were also considered moribund if there was prolonged or excessive pain or distress as defined by clinical observations such as: prostration, hunched posture, paralysis/paresis, distended abdomen, ulcerations, abscesses, seizures and/or hemorrhages.

Figure 20:
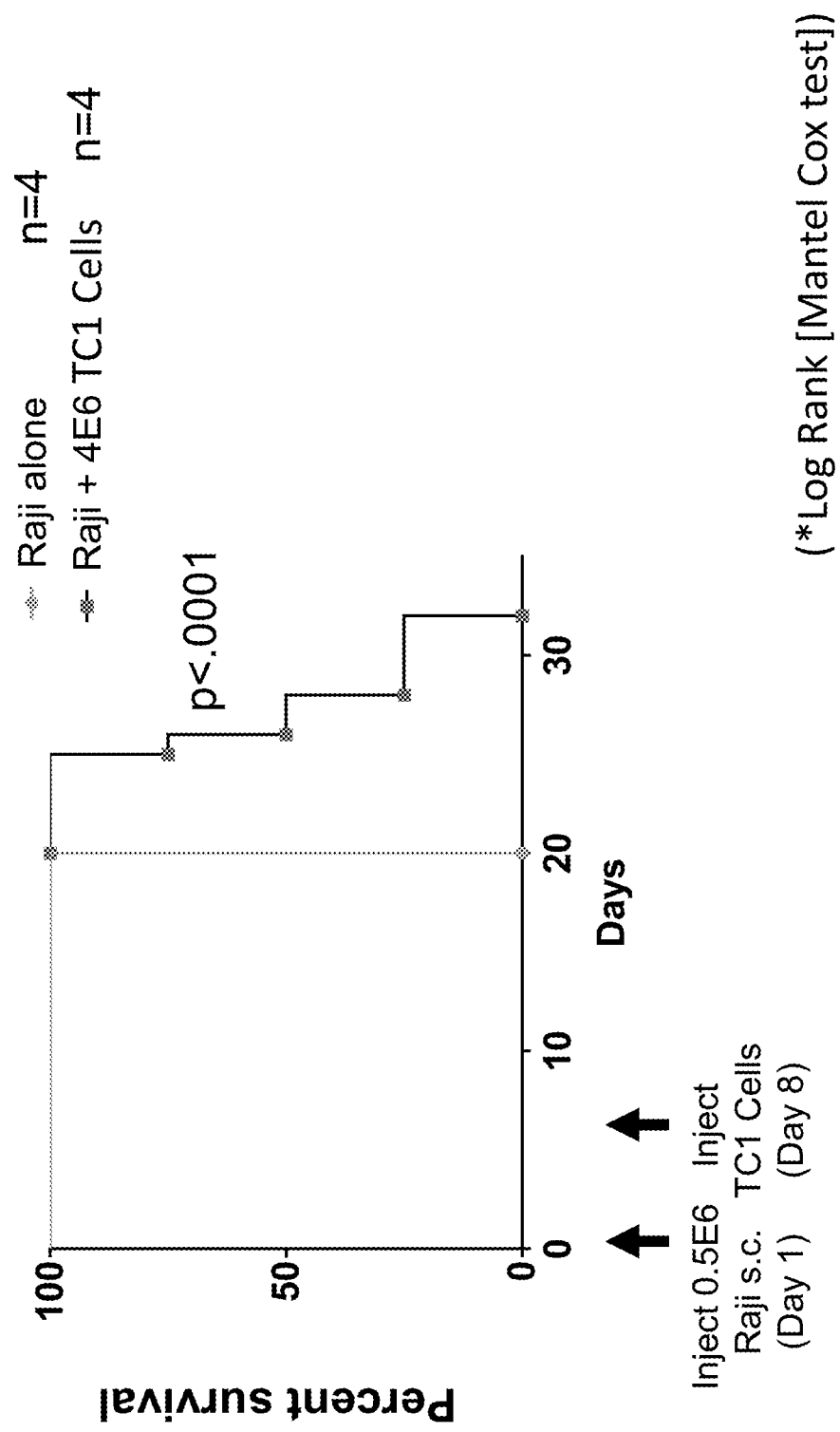
FIG. 20 is a survival curve graph demonstrating increased survival of NOG Raji mice treated with TC1 cells in comparison to NOG Raji mice receiving no treatment.

Similar to the subcutaneous xenograph model (Example 12), the Disseminated Model revealed a statistically significant survival advantage in mice treated with TRAC⁻/B2M⁻CD19CAR+ cells (TC1) as shown in FIG. 20, p<0.0001. The effect of TC1 treatment on survival in the disseminated model was also dose dependent (Table 16).

TABLE 16

Animal survival

| Group | Raji Cells (i.v.) | TC1 Treatment (i.v.) | Max survival (days) | Median survival (days) |
|---|---|---|---|---|
| 1 | No | No | Max | Max |
| 2 | Yes | No | 20 | 20 |
| 3 | Yes | 1 × 10⁶ cells/mouse | 21 | 21 |
| 4 | Yes | 2 × 10⁶ cells/mouse | 25 | 25 |
| 5 | Yes | 4 × 10⁶ cells/mouse | 32 | 26 |

A second experiment was run using the Intravenous Disseminated model described above.

On Day 1 mice in Groups 2-4 received an intravenous injection of 0.5×10⁶ Raji cells/mouse. The mice were inoculated intravenously to model disseminated disease. On Day 4 (3 days post injection with the Raji cells), treatment Groups 2-4 received a single 200 μl intravenous dose of TC1 cells per Table 17.

TABLE 17

Treatment groups

| Group | Raji Cells (i.v.) | TC1 Treatment (i.v.) | N |
|---|---|---|---|
| 1 | $0.5 \times 10^6$ cells/mouse | None | 6 |
| 2 | $0.5 \times 10^6$ cells/mouse | $0.6 \times 10^6$ CAR$^+$ cells/mouse | 7 |
| 3 | $0.5 \times 10^6$ cells/mouse | $1.2 \times 10^6$ CAR$^+$ cells/mouse | 5 |
| 4 | $0.5 \times 10^6$ cells/mouse | $2.4 \times 10^6$ CAR$^+$ cells/mouse | 5 |

Figure 42A:
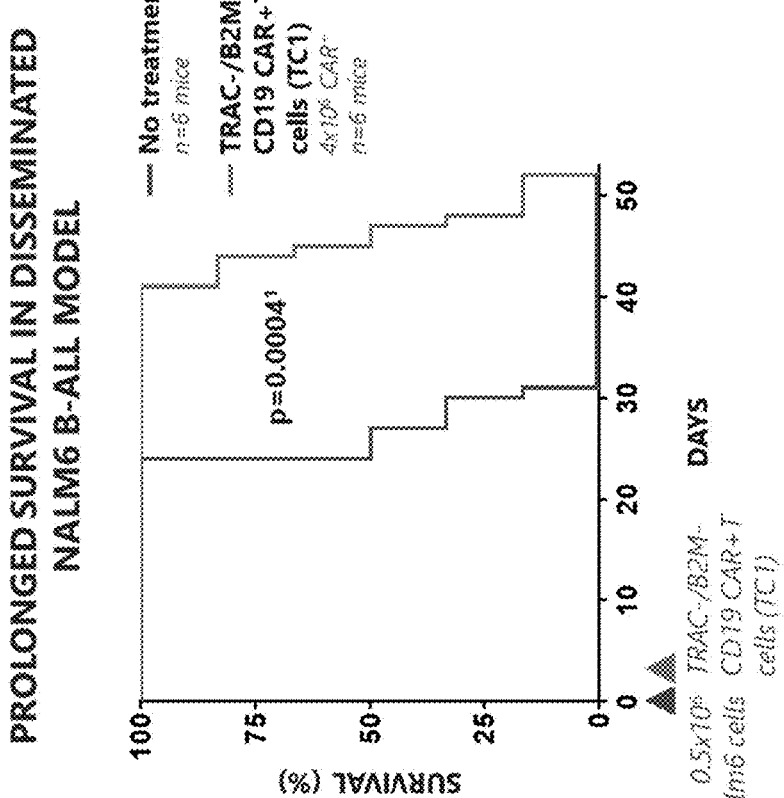
FIGS. 42A and 42B are survival curve graphs demonstrating increased survival of NOG Raji mice (FIG. 42A) or NOG Nalm6 mice (FIG. 42B) treated with TRAC−/B2M−CD19CAR+ T cells (TC1) on Day 4, in comparison to control mice receiving no treatment on Day 1. This was, in part, a modified replicate experiment of FIG. 20.

Again, the Disseminated Model revealed a statistically significant survival advantage in mice treated with TRAC$^-$/B2M$^-$CD19CAR+ cells (TC1) as shown in FIG. 42A, p=0.0016. The effect of TC1 treatment on survival in the disseminated model was also dose dependent (Table 18).

TABLE 18

Animal survival

| Group | Raji Cells (i.v.) | TC1 Treatment (i.v.) | Max survival (days) | Median survival (days) | Significance |
|---|---|---|---|---|---|
| 1 | Yes | No | 20 | 20 | |
| 2 | Yes | $0.6 \times 10^6$ CAR$^+$ cells/mouse | 35 | 27 | p = 0.005 |
| 3 | Yes | $1.2 \times 10^6$ CAR$^+$ cells/mouse | 39 | 37 | p = 0.016 |
| 4 | Yes | $2.4 \times 10^6$ CAR$^+$ cells/mouse | 49 | 46 | p = 0.016 |

Evaluation of Splenic Response to TC1 Treatment

The spleen was collected from mice 2-3 weeks following Raji injection and the tissue was evaluated by flow cytometry for the persistence of TC1 cells and eradication of Raji cells in the spleen.

Flow Cytometry Analysis Procedure

The Spleen was transferred to 3 mL of 1×DPBS CMF in a C tube and dissociated using the MACS Octo Dissociator. The sample was transferred through a 100 micron screen into a 15 mL conical tube, centrifuged (1700 rpm, 5 minutes, ART with brake) and resuspended in 1 mL of 1×DPBS CMF for counting using the Guava PCA. Bone marrow was centrifuged and resuspended in 1 mL of 1×DPBS CMF for counting using the Guava PCA. Cells were resuspended at a concentration of 10×10⁶ cells/mL in 1×DPBS CMF for flow cytometry staining.

Specimens (50 μL) were added to 1 mL 1× Pharm Lyse and incubated for 10-12 minutes at room temperature (RT). Samples were centrifuged and then washed once with 1× DPBS CMF. Samples were resuspended in 50 μL of 1×DPBS and incubated with Human and Mouse TruStain for 10-15 minutes at RT. The samples were washed once with 1 mL 1× DPBS CMF and resuspend in 50 μL of 1×DPBS CMF for staining. Surface antibodies were added and the cells incubated for 15-20 minutes in the dark at RT and then washed with 1 mL 1×DPBS CMF. Then samples were resuspended in 125 μL of 1×DPBS CMF for acquisition on the flow cytometer.

Cells were stained with the following surface antibody panel:

TABLE 19

| FITC | PE | APC | C3 | APCCy7 | V421 | V510 |
|---|---|---|---|---|---|---|
| huCD3 (UCHT1) | huCD45 (HI30) | huCD19 (HIB19) | 7AAD | CD8 (SK1) | CD4 (RPA-T4) | mCD45 (30-F11) |

Cell populations were determined by electronic gating (Pl=total leukocytes) on the basis of forward versus side scatter. Compensation to address spill over from one channel to another was performed upon initial instrument set up using Ultra Comp Beads from Thermo Fisher. The flow cytometer was set to collect 10,000 CD45+ events in each tube. Flow cytometric data acquisition was performed using the FACSCantoII™ flow cytometer. Data was acquired using BO FACSDiva™ software (version 6.1.3 or 8.0.1). Flow cytometry data analysis was in the form of Flow Cytograms, which are graphical representations generated to measure relative percentages for each cell type.

Figure 21:
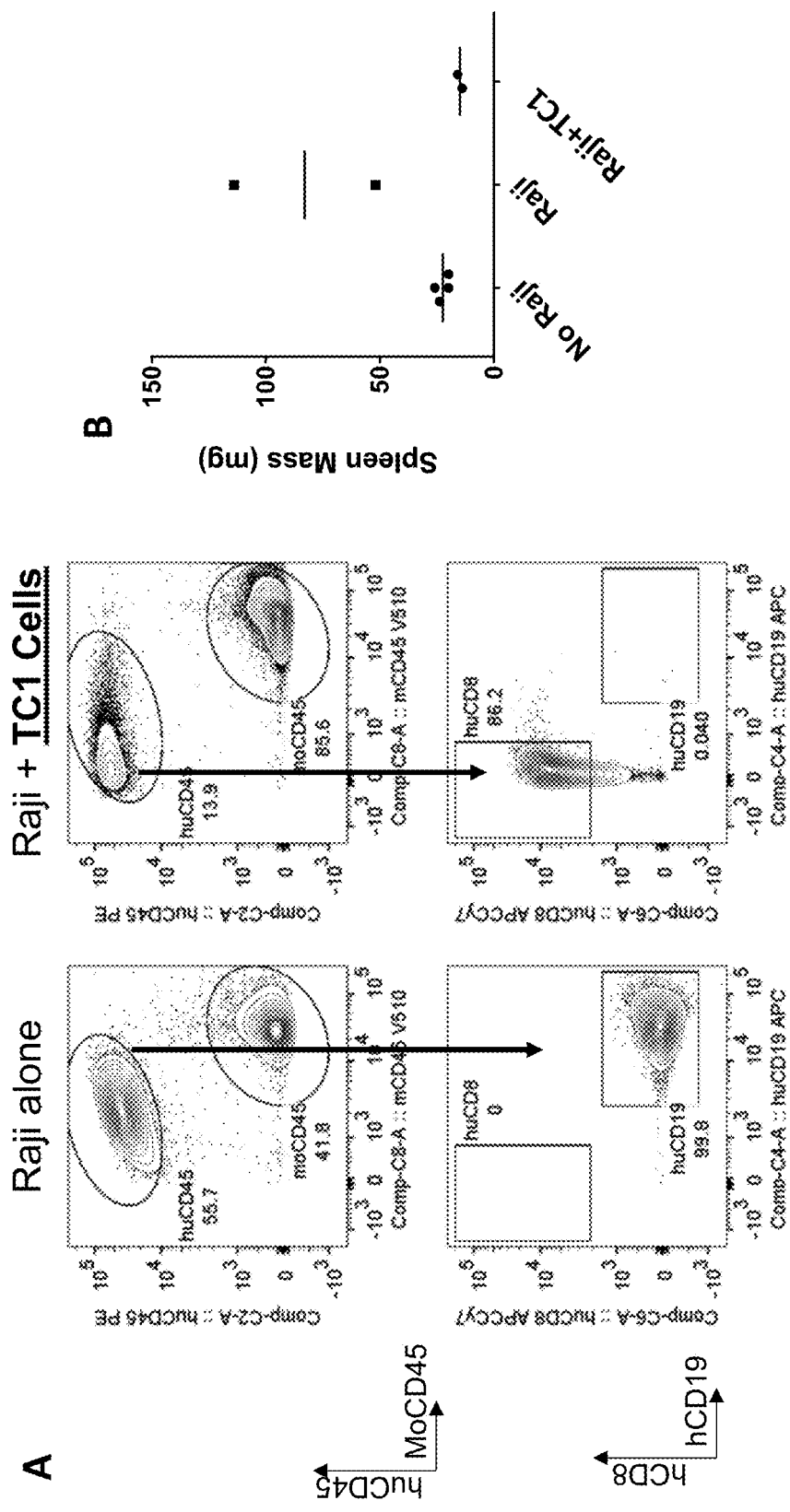
FIG. 21A is a series of flow cytometry plots demonstrating that TC1 cells persist in NOG Raji mice.
FIG. 21B is a graph demonstrating that TC1 cells selectively eradicate splenic Raji cells in NOG Raji mice treated with TC1 in comparison to controls (NOG Raji mice with no treatment or NOG mice). The effect is depicted as a decreased splenic mass in NOG Raji mice treated with TC1 in comparison to controls.
Figure 22:
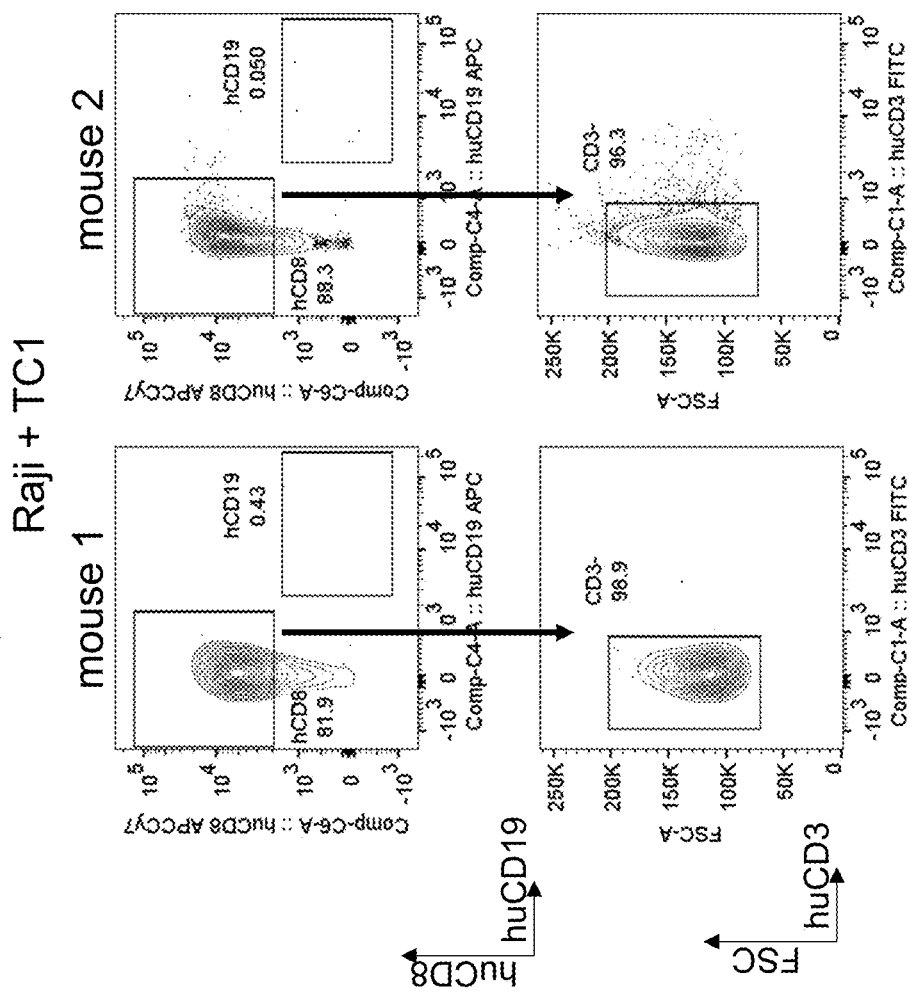
FIG. 22 is a series of flow cytometry plots demonstrating that persistent splenic TC1 cells are edited in two independent NOG Raji mice with TC1 treatment.

This example demonstrates that following TC1 cell treatment, the therapeutically beneficial TRAC$^-$/B2M$^-$CD19CAR+ cells persist in the spleen and selectively eradicate Raji cells from the tissue (FIG. 21A). In addition, treatment with TC1 cells do not exhibit Raji induced increase in cell mass (FIG. 21B). Further, FIG. 22 shows that the remaining human cells in spleens of mice treated with TRAC$^-$/B2M$^-$CD19CAR+ cells are CD8+. These CD8+ T cells are also CD3 negative proving that persistent T cells in this model remain TCR/CD3 negative and are thus edited.

Intravenous Disseminated Nalm-6 Human Acute Lymphoblastic Leukemia Tumor Xenograft Model The Intravenous Disseminated Model (Disseminated Model) using the Nalm-6 Human Acute Lymphoblastic Leukemia tumor cell line in NOG mice was used in this example to further demonstrate the efficacy of TRAC$^-$/B2M$^-$CD19CAR+ cells. Generation of the TRAC$^-$/B2M$^-$CD19CAR+ cells (TC1) used in this model was described in the Examples above and evaluated in the Disseminated Model using methods employed by Translations Drug Development, LLC (Scottsdale, Ariz.) and described herein. In brief, 24, 5-8 week old female CIEA NOG (NOD.Cg-Prkdc$^{scid}$Il2rg$^{tm1Sug}$/JicTac) mice were individually housed in ventilated microisolator cages, maintained under pathogen-free conditions, 5-7 days prior to the start of the study. At the start of the study, the mice were divided into 5 treatment groups as shown in Table 20. On Day 1 mice in Groups 2-4 received an intravenous injection of 0.5×10⁶ Nalm6 cells/mouse. The mice were inoculated intravenously to model disseminated disease. On Day 4 (3 days post injection with the Nalm6 cells), treatment Groups 2-4 received a single 200 μl intravenous dose of TC1 cells per Table 20.

TABLE 20

Treatment groups

| Group | Nalm6 Cells (i.v.) | TC1 Treatment (i.v.) | N |
|---|---|---|---|
| 1 | $0.5 \times 10^6$ cells/mouse | None | 6 |
| 2 | $0.5 \times 10^6$ cells/mouse | $1 \times 10^6$ CAR$^+$ cells/mouse | 6 |
| 3 | $0.5 \times 10^6$ cells/mouse | $2 \times 10^6$ CAR$^+$ cells/mouse | 6 |
| 4 | $0.5 \times 10^6$ cells/mouse | $4 \times 10^6$ CAR$^+$ cells/mouse | 6 |

During the course of the study mice were monitored daily and body weight was measured two times weekly as described above.

Figure 42B:
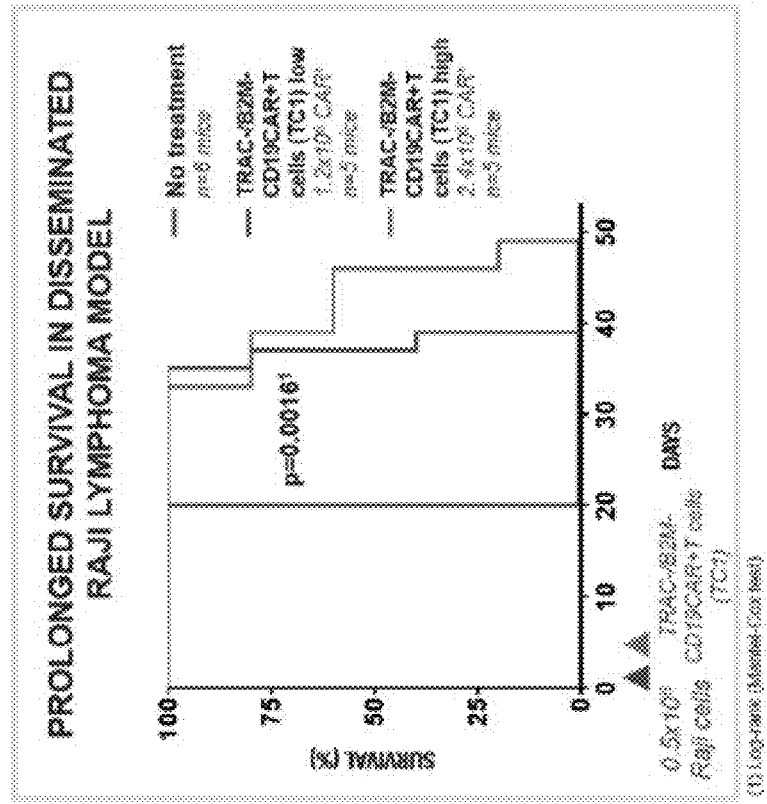
Figure 43:
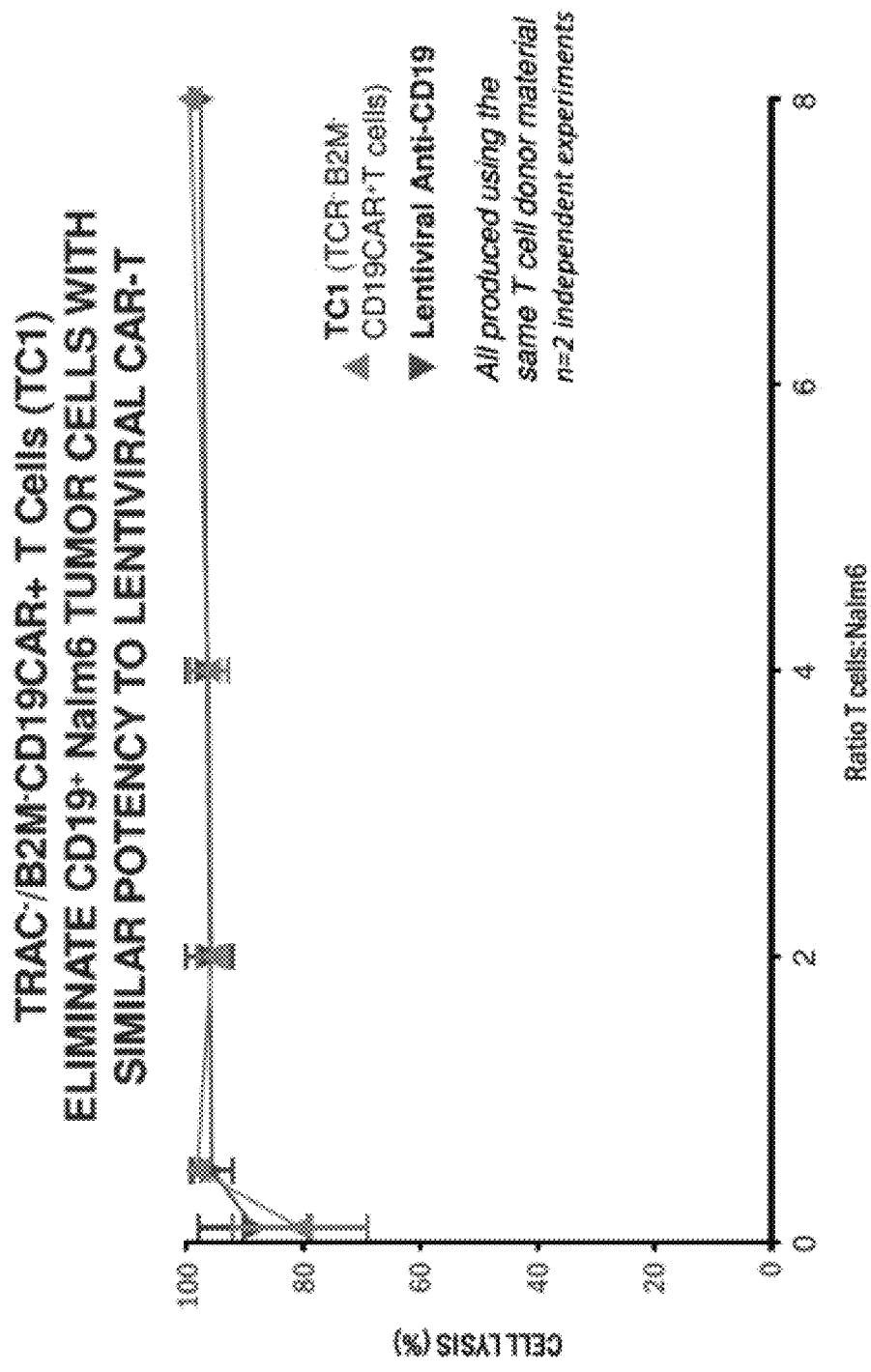
FIG. 43 is a graph showing cell lysis data following treatment of Nalm6 tumor cells with TRAC−/B2M−CD19CAR+ T cells (TC1) or with the CAR-T donor DNA template packaged in a lentivirus vector. Both treatments yielded similar potency with respect to percent cell lysis. Control TCR−CAR− T cells measured in separate experiment showed no cell lysis activity.
Figure 44:
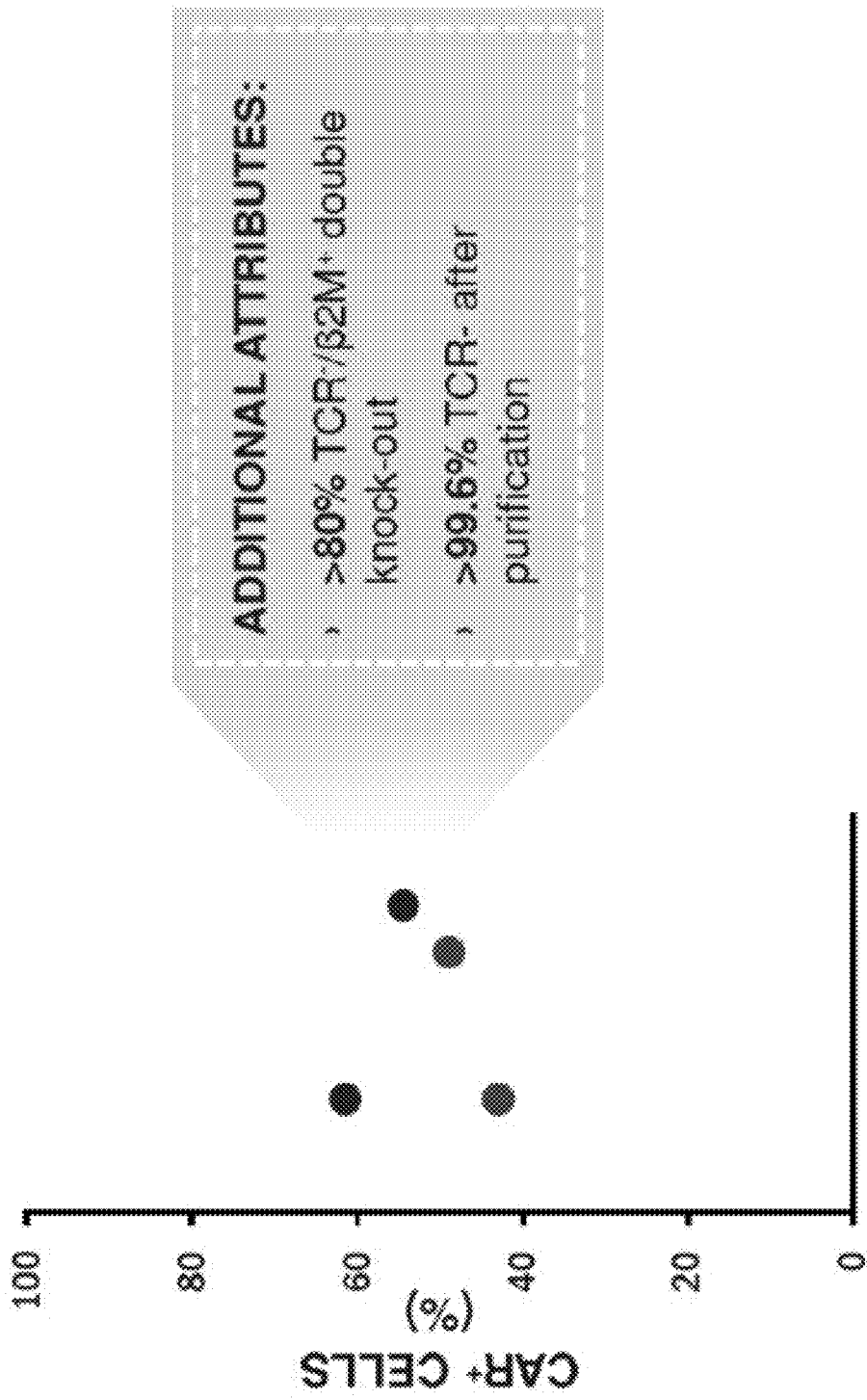
FIG. 44 is a dot plot depicting the consistent percentage of TRAC−/B2M−CD19CAR+ T cells (TC1) that are produced from the donor DNA template. Additionally, in combination with the additional attributes of >80% TCR−/B2M− double knock out and >99.6% TCR-following purification, TC1 production is more homogenous and consistent than other lentiviral CAR-T products.

Similar to the Raji intravenous disseminated model (above), the Nalm6 Model also showed a statistically significant survival advantage in mice treated with TRAC$^-$/B2M$^-$CD19CAR+ cells (TC1) as shown in FIG. 42B, p=0.0004. The effect of TC1 treatment on survival in the Nalm6 disseminated model was also dose dependent (Table 21).

TABLE 21

Animal survival

| Group | Nalm6 Cells (i.v.) | TC1 Treatment (i.v.) | Max survival (days) | Median Survival (days) | Significance |
|---|---|---|---|---|---|
| 2 | Yes | No | 31 | 25.5 | |
| 3 | Yes | 1 × 10$^6$ CAR$^+$ cells/mouse | 32 | 31 | p = 0.03 |
| 4 | Yes | 2 × 10$^6$ CAR$^+$ cells/mouse | 38 | 36 | p = 0.0004 |
| 5 | Yes | 4 × 10$^6$ CAR$^+$ cells/mouse | 52 | 46 | p = 0.0004 |

Example 14—TC1 Proliferation is Cytokine Dependent

The production of the TRAC$^-$/B2M$^-$CD19CAR+ cells, TC1, may result in unwanted off-target editing that could generate cells with adverse properties. One of these adverse properties could be uncontrolled cell growth. In this experiment, we assessed the ability of TC1 cells to grow in the absence of cytokines and/or serum.

1×10$^6$ TC1 cells were plated ~2 weeks post production (Day 0). The number of viable cells were enumerated 7 and 14 days post plating in either full media, 5% human serum without cytokines (IL-2 and IL-7), or base media lacking serum and cytokines. No cells were detected at 14 days plated in the cultures that lacked cytokines suggesting that any potential off-target effects due to genome editing did not bestow growth factor independent growth/proliferation to TC1 cells. The TC1 cells only proliferated in the presence of cytokines (e.g. full media that contains cytokines) and did not proliferate in the presence of serum alone as shown in FIG. 23. Thus, in vivo, the TC1 cells would likely not grow in the absence of cytokine, growth factor or antigen stimulation due to any off-target genome editing.

Example 15—CRISPR/Cas9 Mediated Knockout of TCR and MHC I Components and Expression of CD70 Chimeric Antigen Receptor Constructs This example describes the production by CRISPR/Cas9 and AAV6 of allogeneic human T cells that lack expression of TCR, or TCR and MHC I, and express a chimeric antigen receptor targeting CD70+ cancers.

Figure 24A:
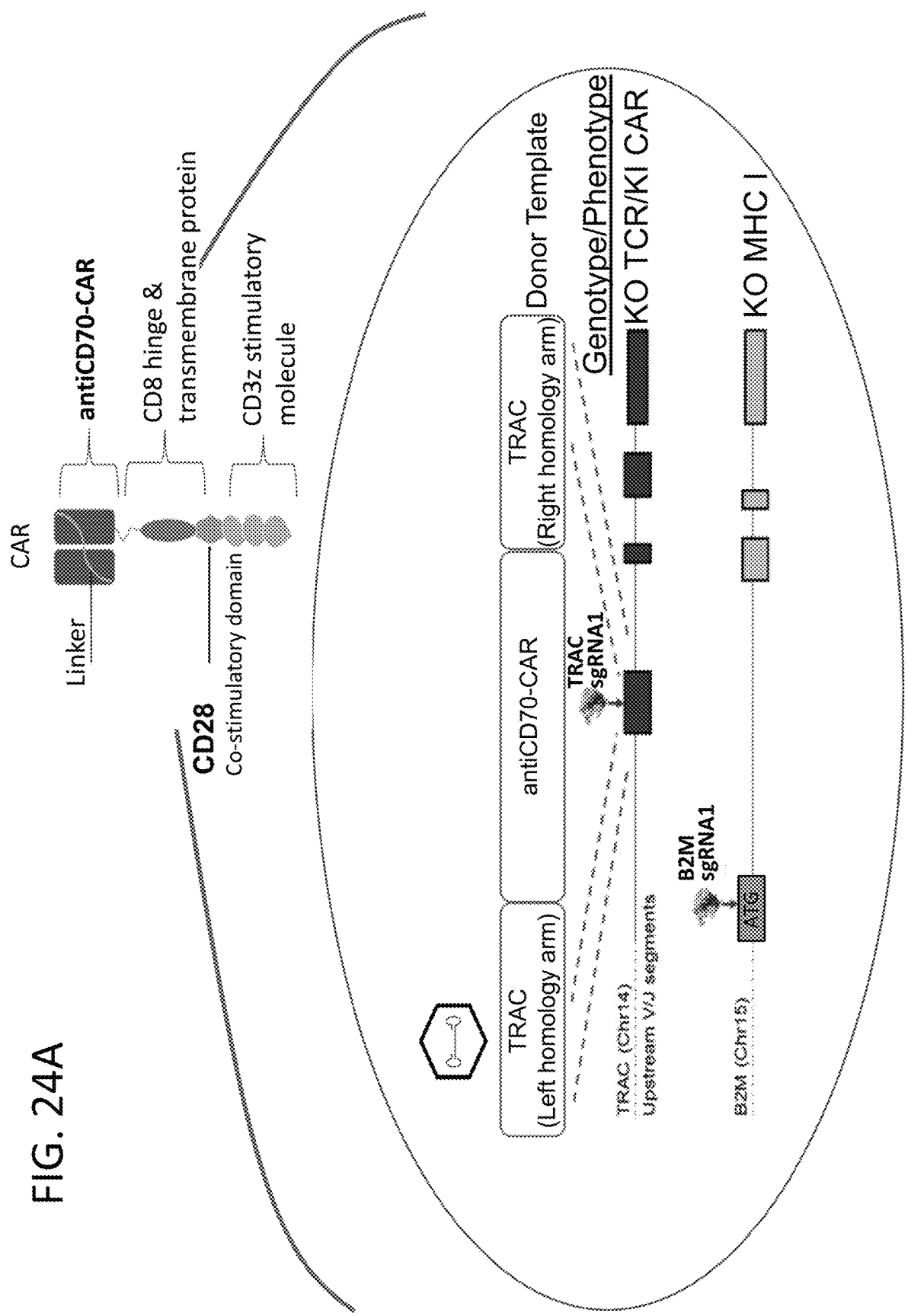
FIG. 24A is a graphical depiction of a CAR-T cell that lacks MHC-I expression produced by CRISPR/Cas9/sgRNAs and AAV6 delivered donor templates. This depiction shows knockout of the TRAC gene with knock-in of a CAR construct into the TRAC locus (mediated by HDR). This depiction also shows deletion of sites in the B2M gene.

A schematic depiction of CRISPR/Cas9 generated allogeneic CAR-T cells is shown in FIG. 24A.

Similar to Example 9 above, CRISPR/Cas9 was used to disrupt (knockout [KO]) the coding sequence of the TCRa constant region gene (TRAC). This disruption leads to loss of function of TCR and renders the gene edited T cell non-alloreactive and suitable for allogeneic transplantation, minimizing the risk of graft versus host disease (GVHD). The DNA double stranded break at the TRAC locus was repaired by homology directed repair with an AAV6-delivered DNA template containing right and left homology arms to the TRAC locus flanking a chimeric antigen receptor cassette (−/+regulatory elements for gene expression). To reduce host versus graft (HVG) (e.g.: host vs CAR-T) and allow for persistence of the allogeneic CAR-T product, the B2M gene was also disrupted using CRISPR/Cas9 components. Together, these genome edits result in a T cell with surface expression of a CAR (expressed from the TRAC locus) targeting CD70+ cancers along with loss of the TCR and MHC I, to reduce GVHD and HVG, respectively. The T cell can be referred to as a TRAC$^-$/B2M$^-$CD70CAR+ cell.

For certain experiments, described in the following examples, single knock-out TRAC-CD70 CAR+ cells were also produced and tested.

Figure 24B:
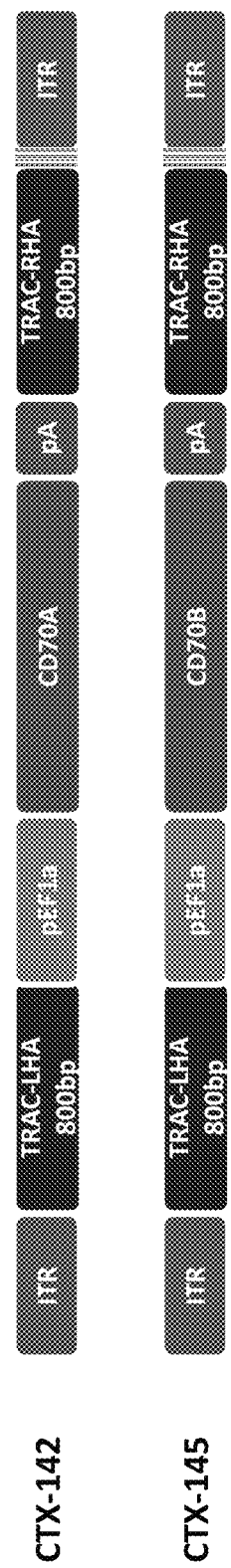
FIG. 24B is a schematic representation of AAV constructs used in production of AAV virus for delivery of donor DNA templates for repair of Cas9 induced double stranded breaks and site-specific transgene insertion.

A schematic of DNA plasmid constructs for production of recombinant AAV virus carrying donor templates to facilitate targeted genomic insertion of CAR expression cassettes by HDR of Cas9-evoked site specific DNA double stranded breaks is shown in FIG. 24B.

TABLE 22

Donor Template Component Sequences

| SEQ ID NO: | Domain Name | Length (bp) |
|---|---|---|
| 1313 | Left ITR (5' ITR) | 145 |
| 1314 | Right ITR (3' ITR) | 145 |
| 1423 | CD70A CAR | 1518 |
| 1424 | CD70B CAR | 1518 |
| 1319 | pA | 49 |
| 1325 | TRAC-LHA (800 bp) | 800 |
| 1326 | TRAC-RHA (800 bp) | 804 |
| 1331 | EF1a | 1178 |

CTX-142 and CTX-145 are derived from CTX-138 but the CAR has been modified to comprise anti-human CD70 scFV coding regions (FIG. 24B) instead of anti-CD19 scFV coding regions; in addition, the CAR is modified to comprise an alternate signal peptide (e.g.: CD8; MALPVTALLL-PLALLLHAARP (SEQ ID NO: 1586)) as compared to the CAR encoded by CTX-138. CTX-142 and CTX-145 are derived from CTX-138 but with the anti-CD19 scFv coding regions replaced with anti-human CD70 scFv coding regions (FIG. 24B). CTX-142 and CTX-145 differ in the orientation of the antiCD70 scFv variable heavy (VH) and variable light (VL) chains. CTX-142 (SEQ ID NO: 1358) contains an anti-CD70 CAR construct (antiCD70A: CD8[signal peptide]-VL-linker-VH-CD8[tm]-CD28[co-stimulatory domain]-CD3z) (SEQ ID NO: 1423) with a synthetic 3' poly adenylation sequence (pA) whose expression is driven by the EF1a promoter. The scFv is constructed such that the VL chain is amino terminal to the VH chain. CTX-142 (SEQ ID NO: 1358) also contains 800 bp homology arms flanking a genomic Cas9/sgRNA target site in the TRAC locus. CTX-145 (SEQ ID NO: 1359) is similar to CTX-142, however the antiCD70 CAR construct (contains an antiCD70 CAR construct (antiCD70B: CD8[signal peptide]-VH-linker-VL-CD8[tm]-CD28[co-stimulatory domain]-CD3z) (SEQ ID NO: 1424) switched the orientation of the VH and VL chains, the VH is animo terminal to the VL.

Anti CD70 CAR T cells were produced with CRISPR/Cas9 and AAV components as described (herein). Transgene insertion in primary human T cells via homology directed repair (HDR) and concurrent gene knockout by Cas9: sgRNA RNA was performed as described above in Examples 8 and 9. Primary human T cells were first electroporated with Cas9 or Cas9:sgRNA RNP complexes targeting TRAC (AGAGCAACAGTGCTGTGGCC (SEQ ID NO: 76); comprising sgRNA (SEQ ID NO: 1343) and B2M1 (GCTACTCTCTCTTTCTGGCC (SEQ ID NO: 417); comprising sgRNA (SEQ ID NO: 1345). The gRNAs used in this Example comprise the following spacer sequences: TRAC gRNA spacer (AGAGCAACAGUGCUGUGGCC (SEQ ID NO: 152)); and B2M gRNA spacer (GCUACUCUCUUUCUGGCC (SEQ ID NO: 466)).

sgRNA sequences can be modified as follows: TRAC SEQ ID NO: 1342, B2M SEQ ID NO: 1345.

The DNA double stranded break at the TRAC locus was repaired by homology directed repair with an AAV6-delivered DNA template (CTX-142 or CTX-145).

Example 16—HDR-Mediated Concurrent Transgene Insertion in Cells to Generate TRAC–CD70CAR+ and TRAC–B2M–CD70CAR+ Cells This example demonstrates efficient transgene insertion and concurrent gene knockout by Cas9:sgRNA RNP (for double stranded break induction) and AAV6 delivered donor template (CTX-142 or CTX-145) containing a CD70 CAR construct in primary human T cells.

Primary human T cells were activated with CD3/CD28 magnetic beads (as described previously in Example 2). Three days later activation beads were removed. The next day cells were electroporated with RNP complexes including sgRNAs targeting either TRAC alone, or TRAC+B2M (2 separately complexed RNPs). 7 days post manipulation, cells were analyzed by flow cytometry, as previously described herein and in Example 2.

Guides used in this example target:

```
                                            (SEQ ID NO: 76)
TRAC:    AGAGCAACAGTGCTGTGGCC; and comprise TRAC sgRNA (SEQ ID NO: 1343)

(SEQ ID NO: 417)
B2M:     GCTACTCTCTCTTTCTGGCC; and comprise B2M sgRNA (SEQ ID NO: 1345)
```

The gRNAs used in this Example comprise the following spacer sequences: TRAC gRNA spacer (AGAGCAACAGUGCUGUGGCC (SEQ ID NO: 152)); and B2M gRNA spacer (GCUACUCUCUCUUUCUGGCC (SEQ ID NO: 466)).

sgRNA sequences can be modified as follows: TRAC SEQ ID NO: 1342, B2M SEQ ID NO: 1344.

Figure 25A:
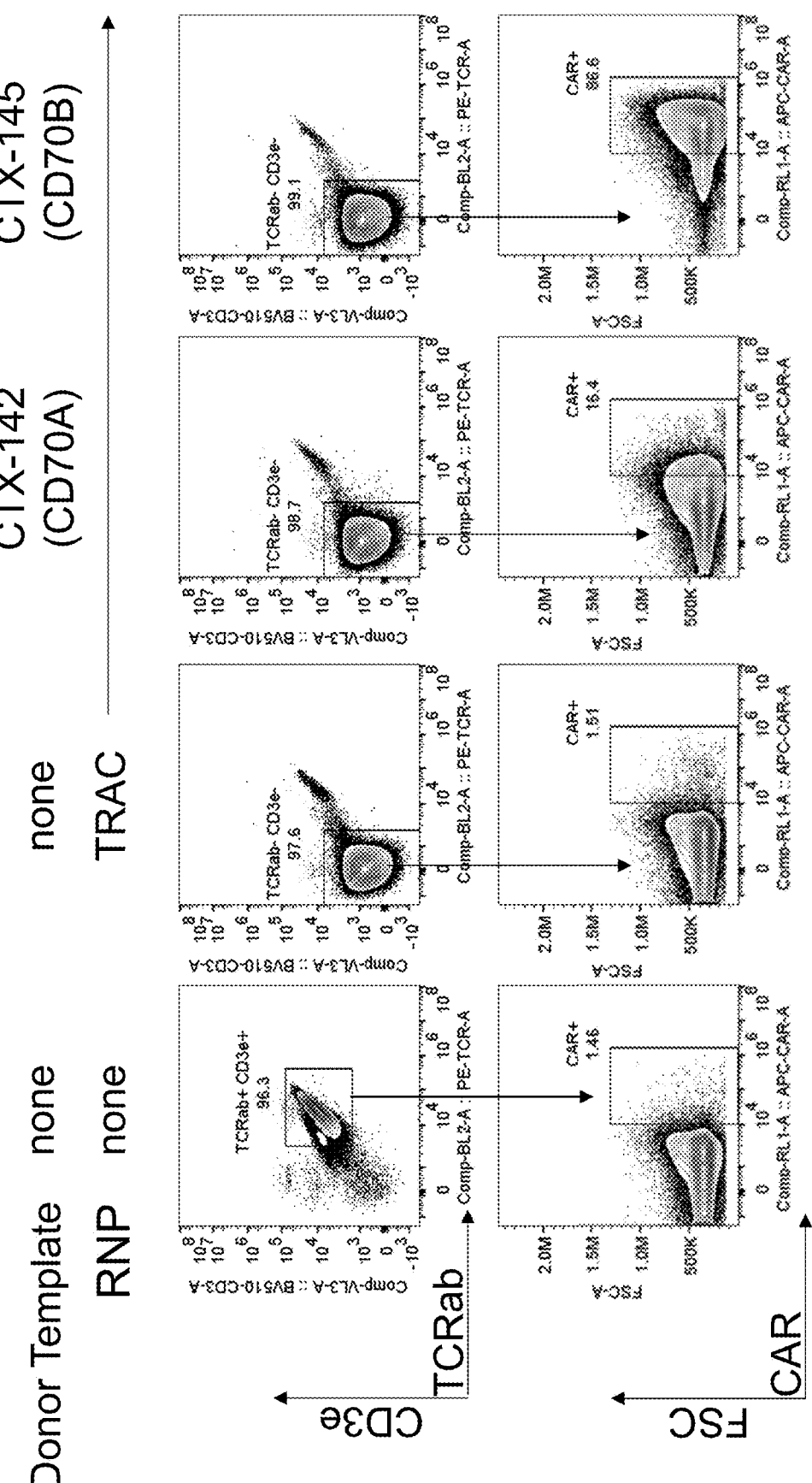
FIG. 25A is flow cytometry data demonstrating the production of TRAC−CD70CAR+ T cells using TRAC sgRNA containing RNPs and AAV6 to deliver the CTX-145 donor template into T cells.
Figure 25B:
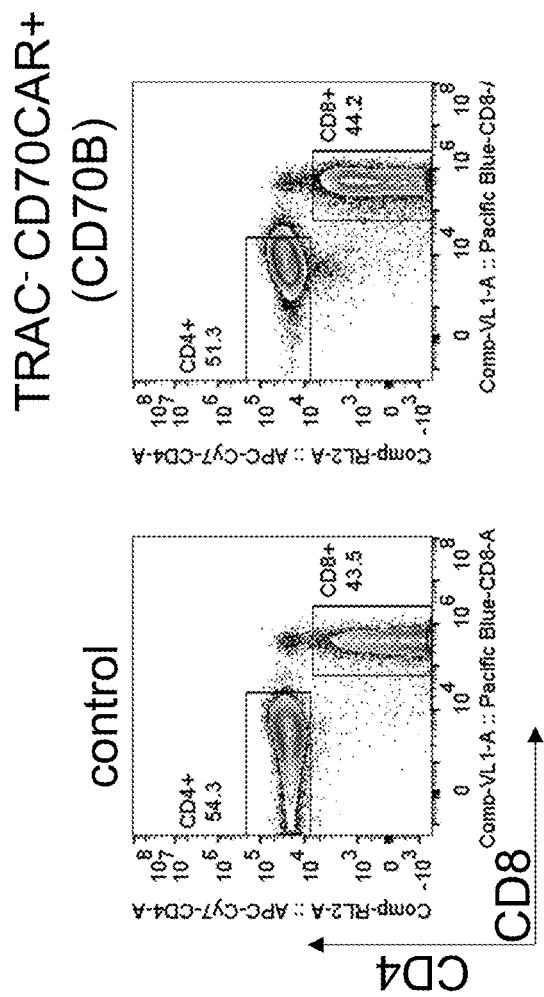
FIG. 25B shows the maintenance of CD4/CD8 subset proportions in TRAC−CD70CAR+ T cells generated using TRAC sgRNA containing RNPs and AAV6 to deliver the CTX-145 donor template into T cells.

FIG. 25A shows that cells treated with TRAC sgRNA containing RNP and CTX-145 AAV6 produced higher levels of expression of a CAR construct, while cells treated with a TRAC sgRNA RNP and CTX-142 AAV6 were not as effective at producing CD70 CAR expressing cells. FIG. 25B demonstrates normal proportions of CD4/CD8 T cell subsets maintained in the TRAC negative CAR+ fraction from cells treated with TRAC sgRNA containing RNP and CTX-145 AAV6, suggesting that the expression of a genetically engineered anti CD70 CAR T cell affects the proportion of T cell subsets.

Figure 26:
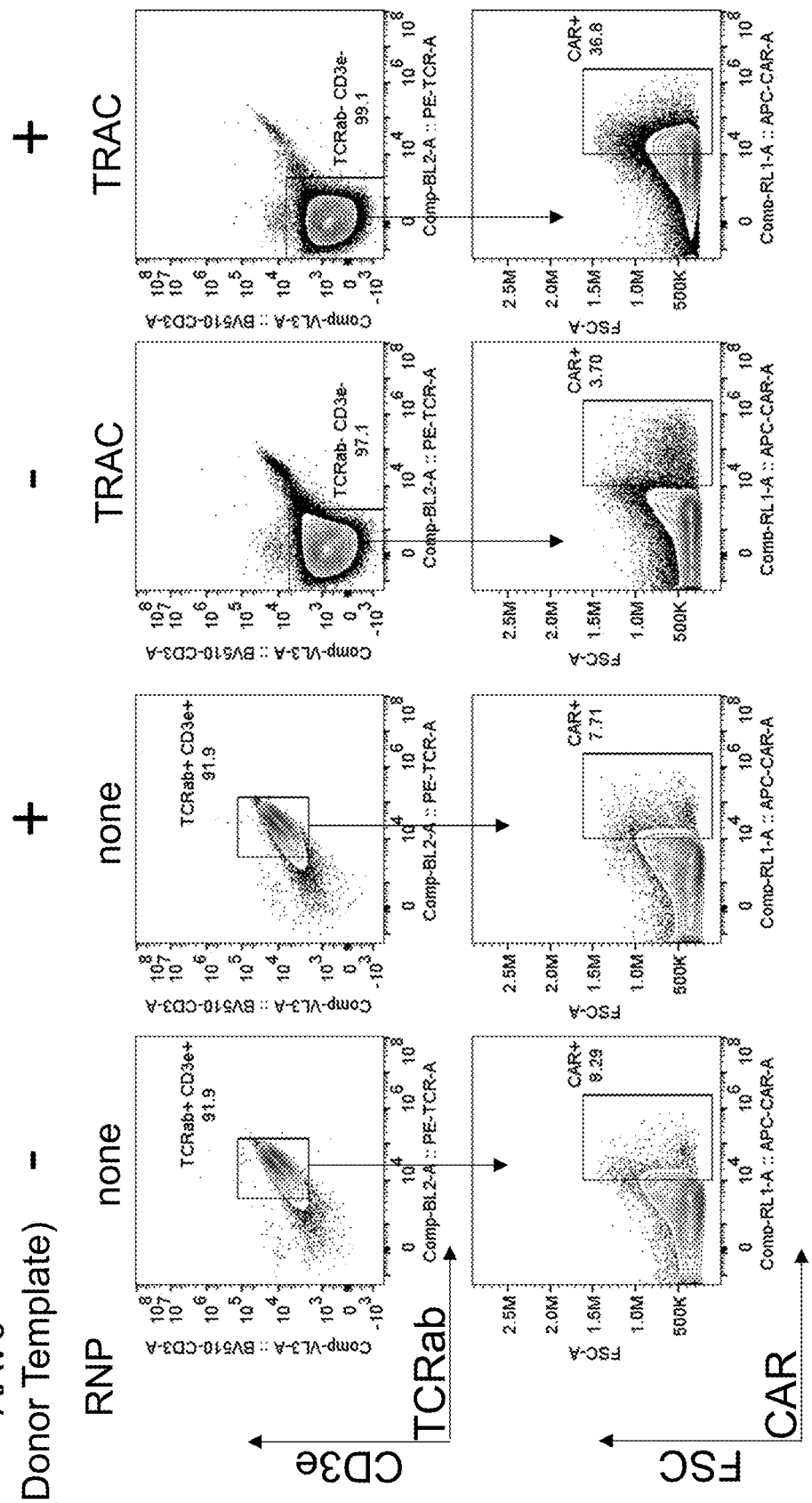
FIG. 26 is flow cytometry data demonstrating expression of the CD70CAR construct only when there is RNP to induce a double stranded break at the TRAC locus. Expression of the CD70 CAR construct does not occur with episomal AAV6 vector.

In addition, cells infected with AAV6 encoding CTX-145 alone do not express high levels of anti CD70 CAR. A double stranded break induced by a TRAC sgRNA containing RNP and subsequent repair by HDR using CTX-145 donor template is required for surface expression of anti CD70 CAR (FIG. 26). Thus, the CTX-145 construct is only expressed following integration into the TRAC gene and would not be expressed in cells that were not treated with both the TRAC RNP and AAV vector.

Figure 27:
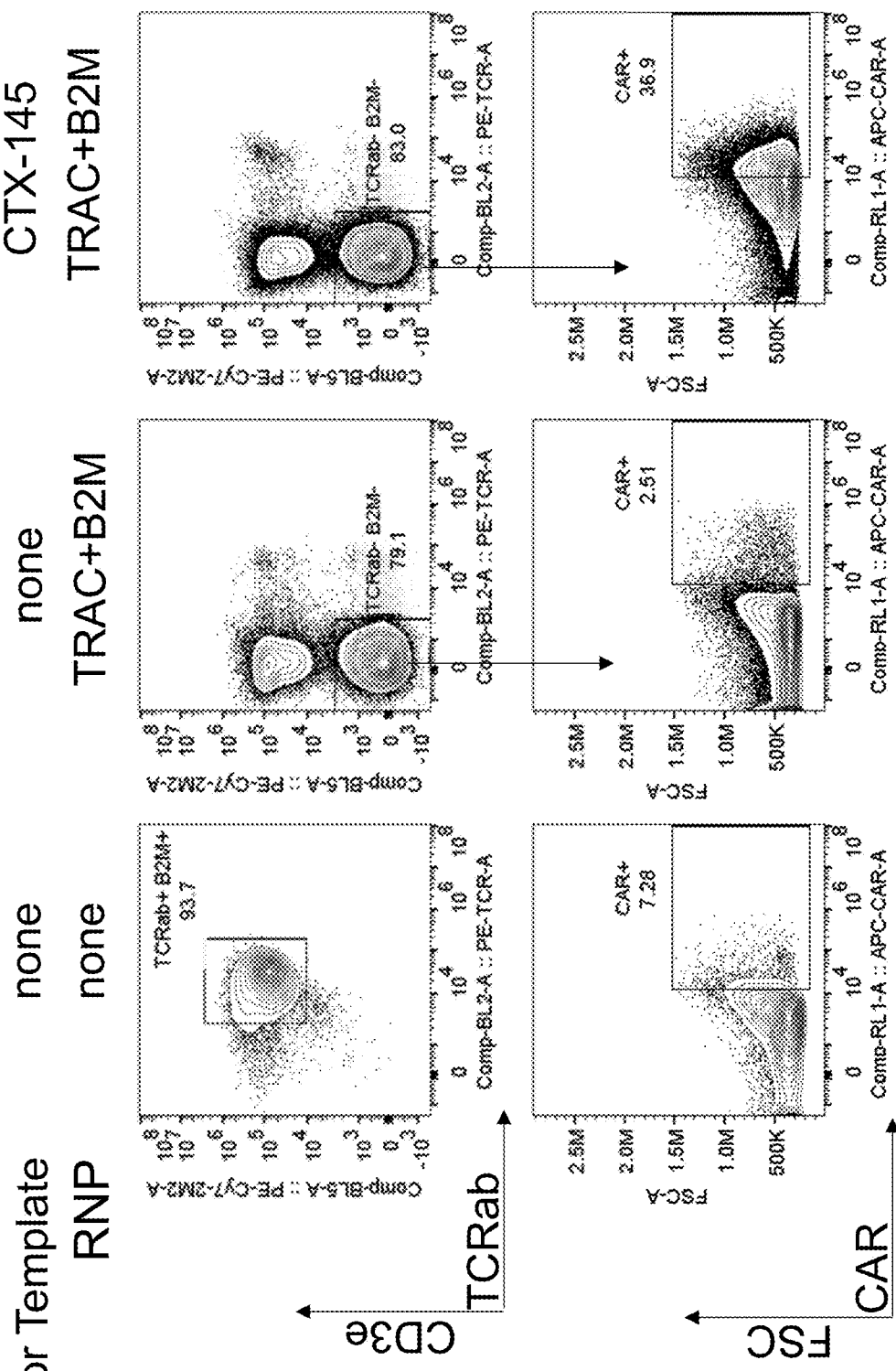
FIG. 27 is flow cytometry data showing the production of CD70CAR-T with TCR and B2M deletions.

FIG. 27 demonstrates successful production of single human T cells lacking TCR and B2M surface expression with concurrent expression of the CD70 CAR from an integrated transgene in the TRAC locus using the methods described above (TCR−/B2M−CD70CAR+).

Figure 36A:
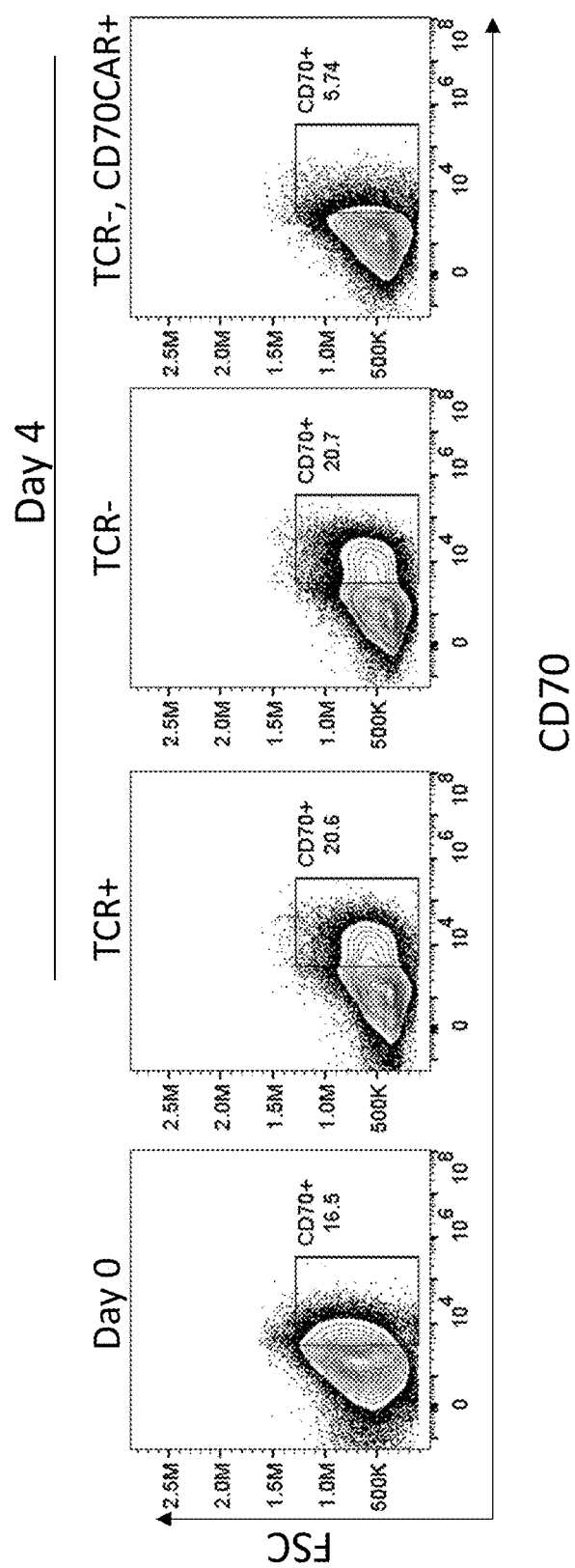
FIG. 36A are a series of flow cytometry graphs showing the percentage of cells expressing CD70 during the production of CD70 CAR+ T-cells.
Figure 36B:
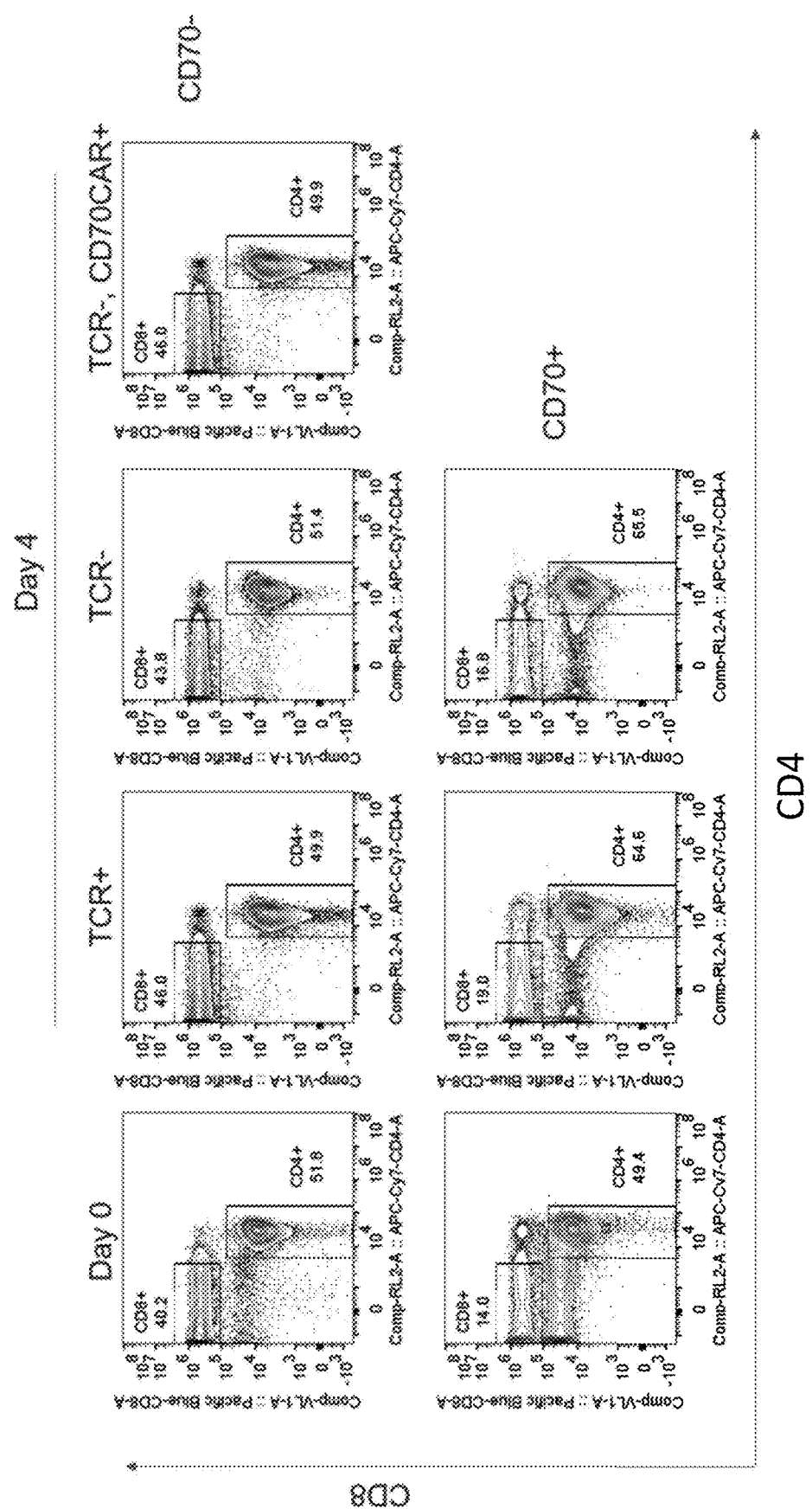
FIG. 36B are a series of flow cytometry graphs depicting proportions of T cells that express one or more of CD4, CD8, TCR or CD70 CAR. The top panel of plots correspond to CD70− population of cells from FIG. 36A. The bottom panel of plots correspond to CD70+ population of cells from FIG. 36A.

The percentage of cells expressing CD70 was tracked during the production of CD70 CAR-T cells. At day 0 a small percentage of T cells express CD70 and are mostly CD4+ (FIG. 36A). These percentages are consistent 4 days post electroporation/infection with AAV6 except in cells that become CD70CAR+. CD70CAR+ cultures lack cells expressing CD70. The high frequency of CD70CAR+ cells along with the lack of CD70 expression in antiCD70-CAR+ cultures suggests that CD70+ T cells serve as targets of antiCD70-CART cells which leads to the fratricide of CD70+ T cells along with the expansion of antiCD70-CAR-T cells (FIG. 36B—Top panel corresponds to CD70− cells from FIG. 36A; Bottom panel corresponds to CD70+ cells from FIG. 36A).

Example 17—Generation of CD70 Expressing Cell Lines

Figure 28A:
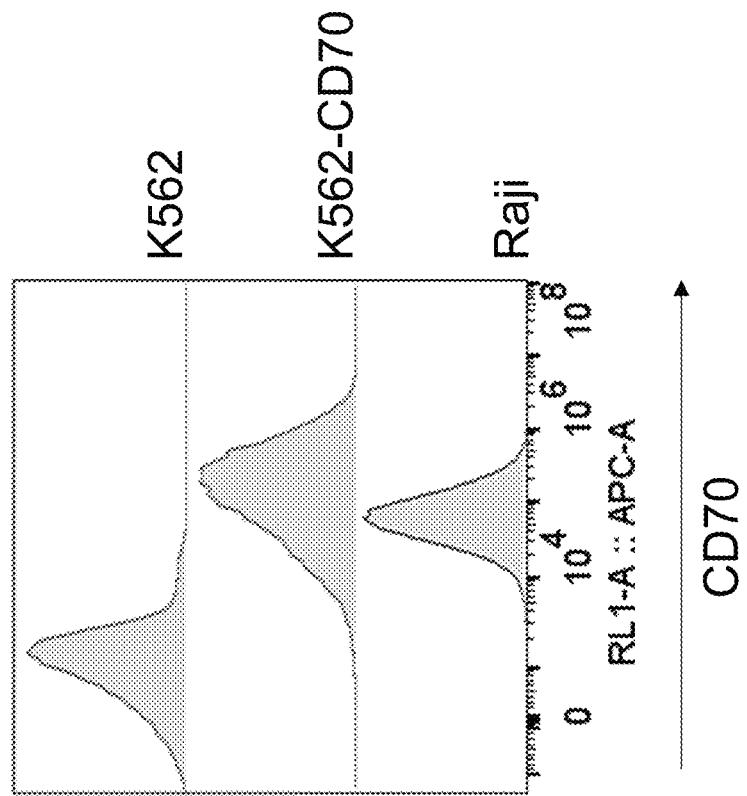
FIG. 28A is a histogram from flow cytometry data showing increased expression of CD70 from K562-CD70 cells that were subsequently used in a functional assay.

K562 cells were infected with lentiviral particles encoding a human CD70 cDNA under the control of the EF1a promoter as a well as a puromycin expression cassette (Genecopoeia). Cells were selected in 2 mg/mL puromycin for 4-7 days and assayed for CD70 surface expression using an Alexa fluor 647 conjugated anti-CD70 antibody (Biolegend, 355115). FIG. 28A demonstrates high surface expression of CD70 on CD70 overexpressing K562 cells (CD70+ K562) compared to parental K562 cells and comparable expression levels to native CD70 expressed on the Raji cell line.

Figure 28B:
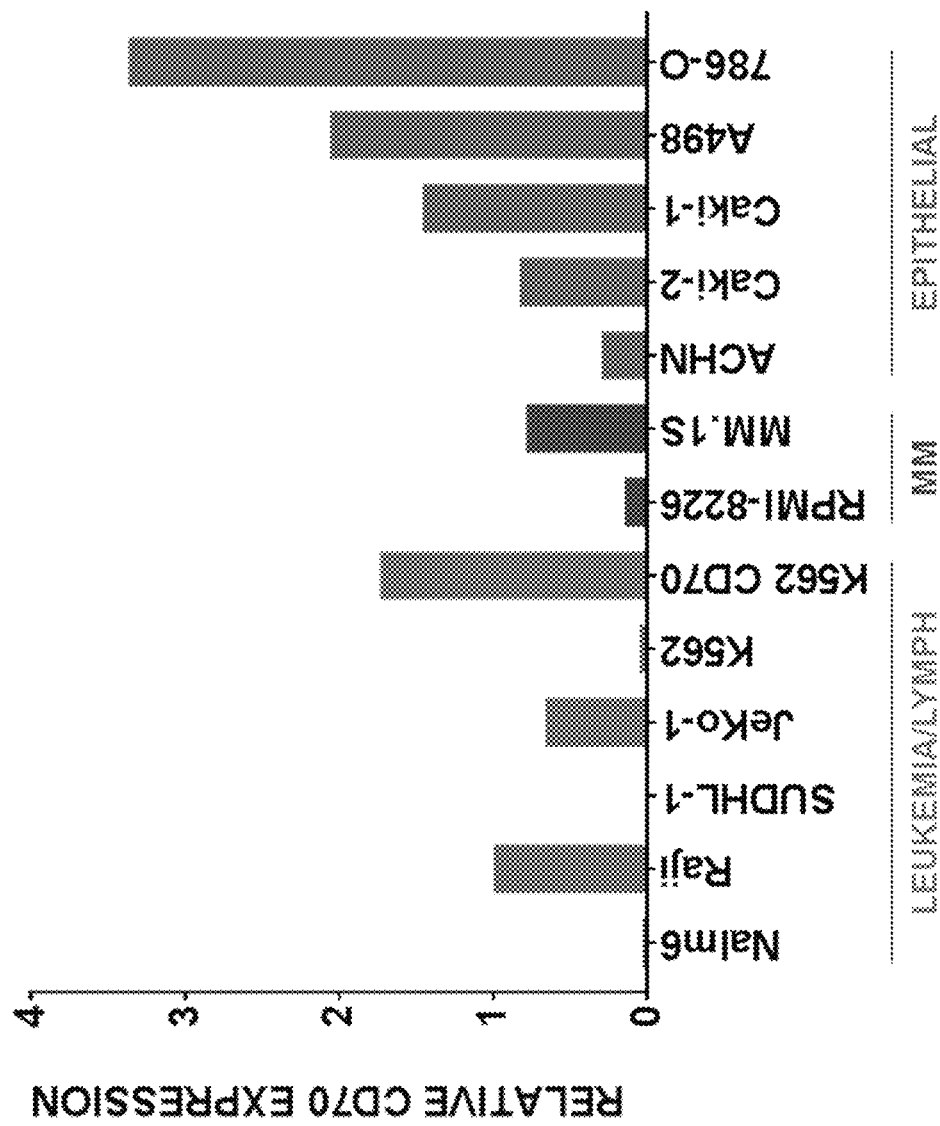
FIG. 28B is a graph showing native CD70 expression levels in a panel of cell lines. The data is normalized to CD70 expression in Raji cells.

A panel of other cell lines was also tested for CD70 surface expression using flow cytometry: Nalm6 (lymphoid), 293 (embryonic kidney), ACHN (renal), Caki-2 (renal), Raji (lymphoid), Caki-1 (renal), A498 (renal), and 786-0 (renal). The results are shown in FIG. 28B. Raji, Caki-1 and A498 cell lines exhibited the highest levels of CD70 surface expression in this assay. These cell lines and the CD70 expressing K562 cells can be used to evaluate effector function and specificity of TCR−/anti-CD70 CAR+ and TCR−B2M−/anti-CD70 CAR+.

Example 18—Evaluation of Effector Function in CRISPR/Cas9 Modified T Cells Expressing a CD70 Chimeric Antigen Receptor (CAR)

Interferon Gamma Stimulation by Genetically Engineered T Cells Expressing a CD70 CAR The ability of the engineered cells to produce interferon gamma (IFNγ) in a target cell was analyzed using an ELISA assay, as described above and in Example 10.

The specificity of genetically modified T cells expressing a CD70 CAR integrated into the TRAC gene, was evaluated in an in vitro ELISA assay. IFNγ from supernatants of cell co-cultures was measured. Only TRAC−/anti-CD70 CAR+ cells secrete high levels of IFNγ when cultured with CD70+ K562. IFNγ secretion was not detected when TRAC−/anti-CD70 CAR+ cells were cultured with K562 cells that were not engineered to overexpress surface CD70 (FIG. 5A) (at a 4:1 CAR-T cell to target ratio).

Figure 29A:
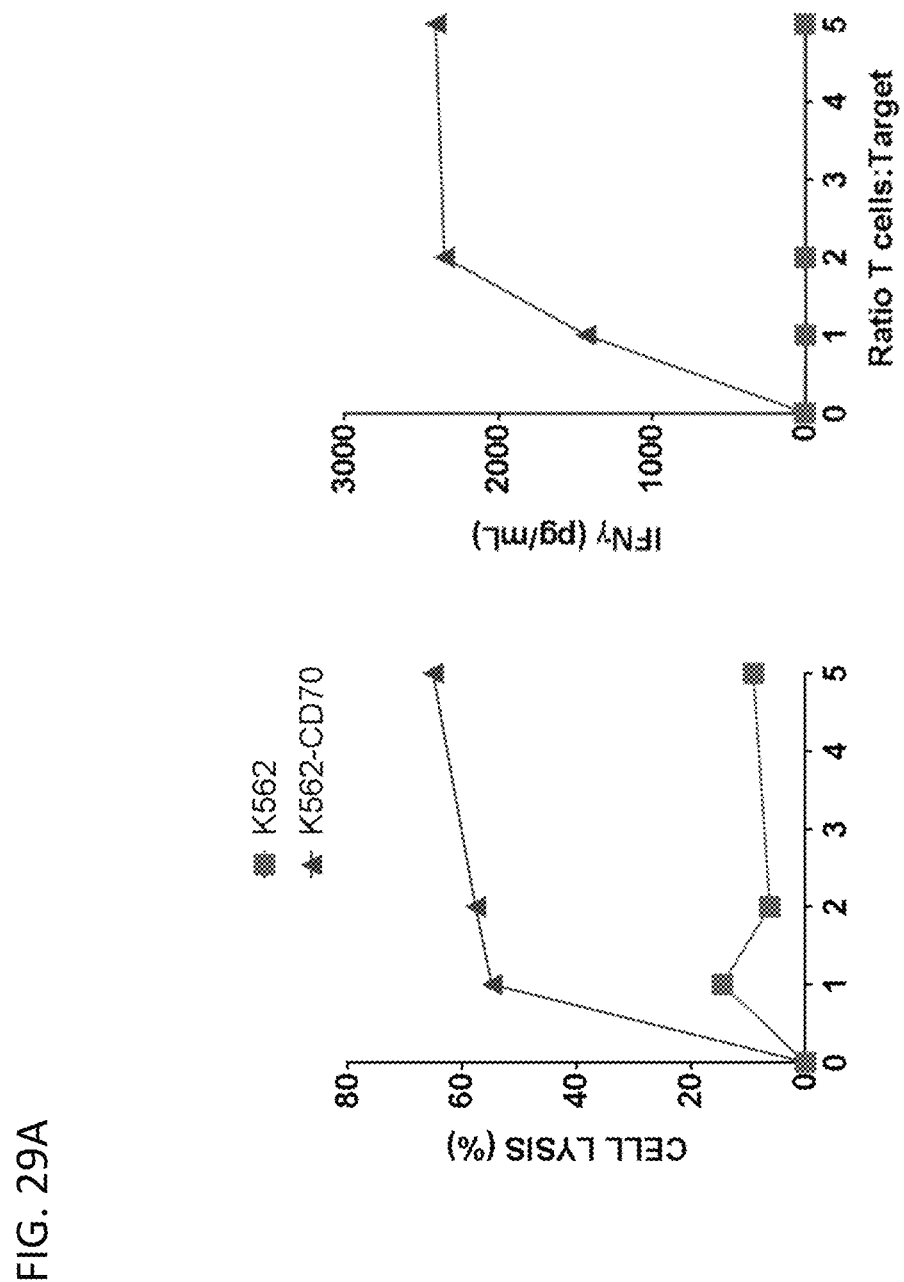
FIG. 29A is a graph showing % cell lysis of CD70 expressing K562 cells (CD70-K562) in the presence of TRAC−/anti-CD70 CAR+ T cells (left panel) and IFNγ secretion from TRAC−/anti-CD70 CAR+ T cells only when they interact with CD70 expressing K562 cells (CD70-K562) (right panel).
Figure 29C:
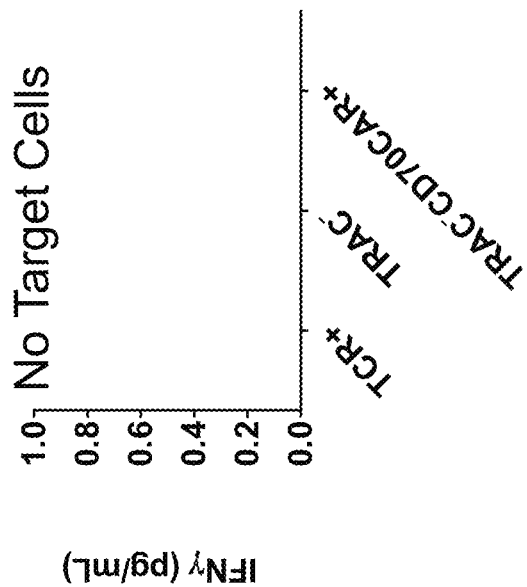
FIG. 29C is a graph showing that TRAC−/anti-CD70 CAR+ T cells (TRAC−CD70CAR+) do not secrete IFNγ due to "self" stimulation when only TRAC−/anti-CD70 CAR+ T cells are present alone in the absence of CD70 expressing target cells.

Similarly, the TRAC−/anti-CD70CAR+ cells only stimulated IFNγ CD70+ Raji cells, but not the CD70− Nalm6 cells (FIG. 29B) (at a 2:1 CAR-T cell to target ratio). TRAC−/anti-CD70 CAR+ T cells did not secrete detectable levels of IFNγ when cultured by themselves in the absence of target cells (FIG. 29C).

GranzymeB Assay

Figure 29B:
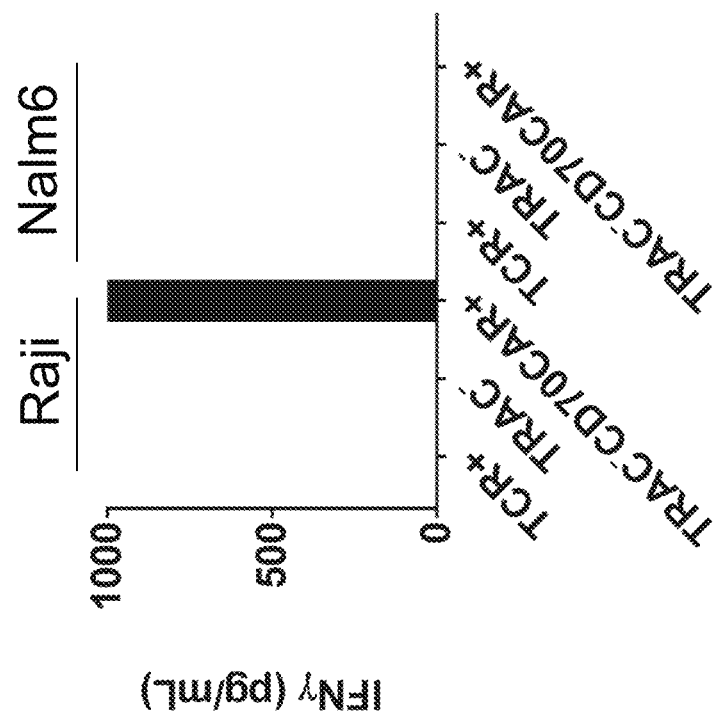
FIG. 29B is a graph depicting IFNγ secretion from TRAC−/anti-CD70 CAR+ T cells (TRAC−CD70CAR+) only when co-cultured with CD70+ Raji cells, and not in the CD70 negative Nalm6 cells.
Figure 29D:
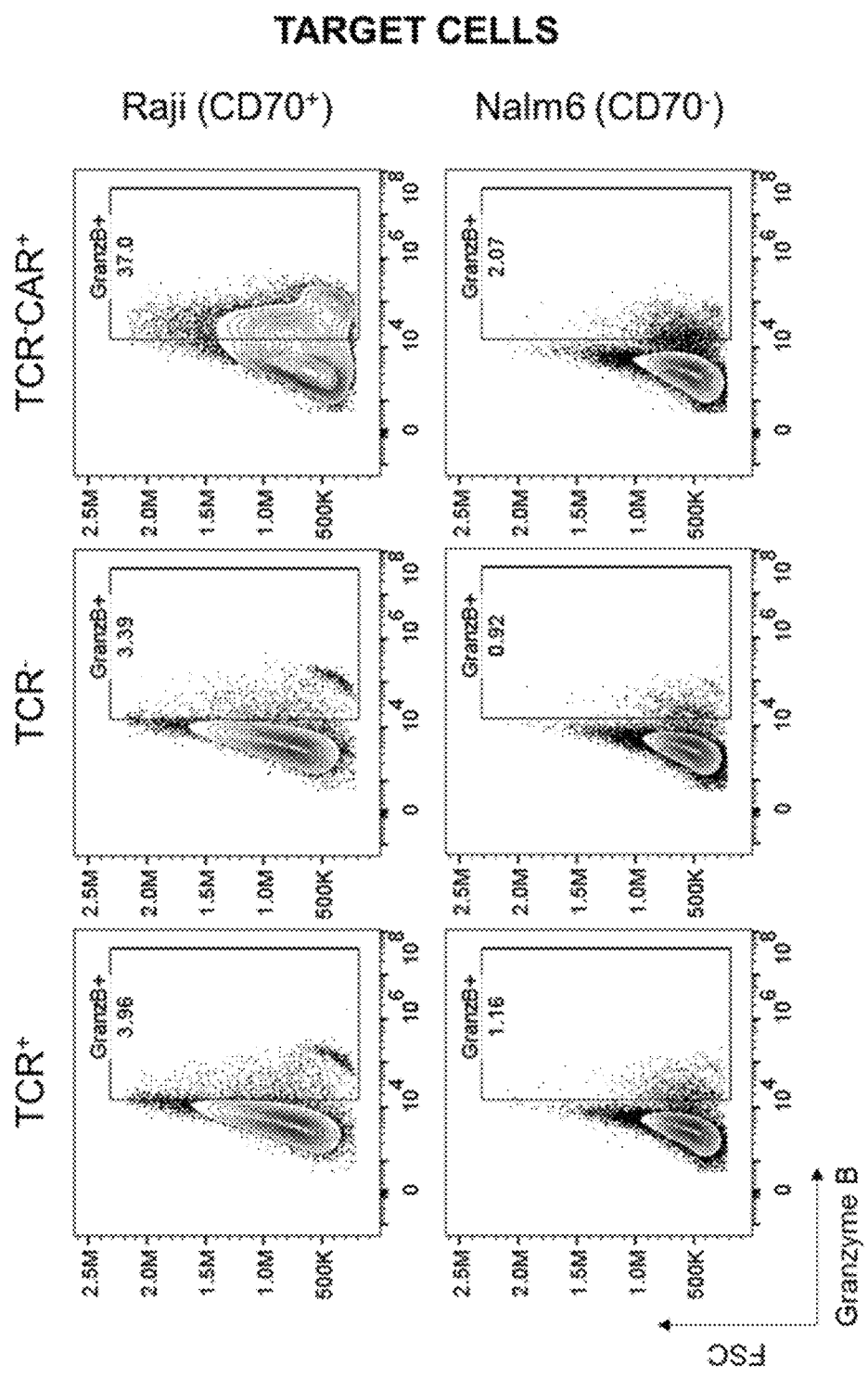
FIG. 29D is flow cytometry data demonstrating GranzymeB activity only in the CD70+ expressing target cells (Raji) that interacted with TRAC−/anti-CD70 CAR+ T cells (TCR-CAR+).

To further assess the effector functions of TRAC−/anti-CD70CAR+ cells, intracellular GranzymeB levels in target cells were measured in a surrogate cell lysis assay. Target cells that are GranzymeB+ had perforin containing membrane pores formed and subsequent injection of GranzymeB through the pores to initiate apoptosis by the TRAC−/anti-CD70CAR+ cells. The GranToxiLux assay was performed with either Raji cells (CD70 positive cells) or Nalm6 cells (CD70 negative cells) according to the manufacturer's instructions (Oncoimmunin Inc.). Fluorescently labeled target cells were co-cultured at a 2:1 ratio with test T cells (e.g.: TRAC−/anti-CD70CAR+:Target cells) in GranzymebB substrate for 2 hrs at 37° C. Cells were then washed and % of target cells positive for GranzymeB activity was quantitated by flow cytometry. Other control test cells were also evaluated at similar ratios (unedited T cells (TRC+) and TRAC− T cells). FIG. 29B shows efficient GranzymeB insertion and activity by TRAC−/anti-CD70CAR+ cells only in Raji cells (CD70+) and not in Nalm6 cells (CD70−). The other control cells tested did not induce GranzymeB insertion and activity in any target cell type. Thus, TRAC−/anti-CD70CAR+ cells can induce lysis of CD70 positive target cells.

Cell Kill Assay in Adherent Renal Cell Carcinoma—In the Context of CD28 Co-Stim

Figure 30A:
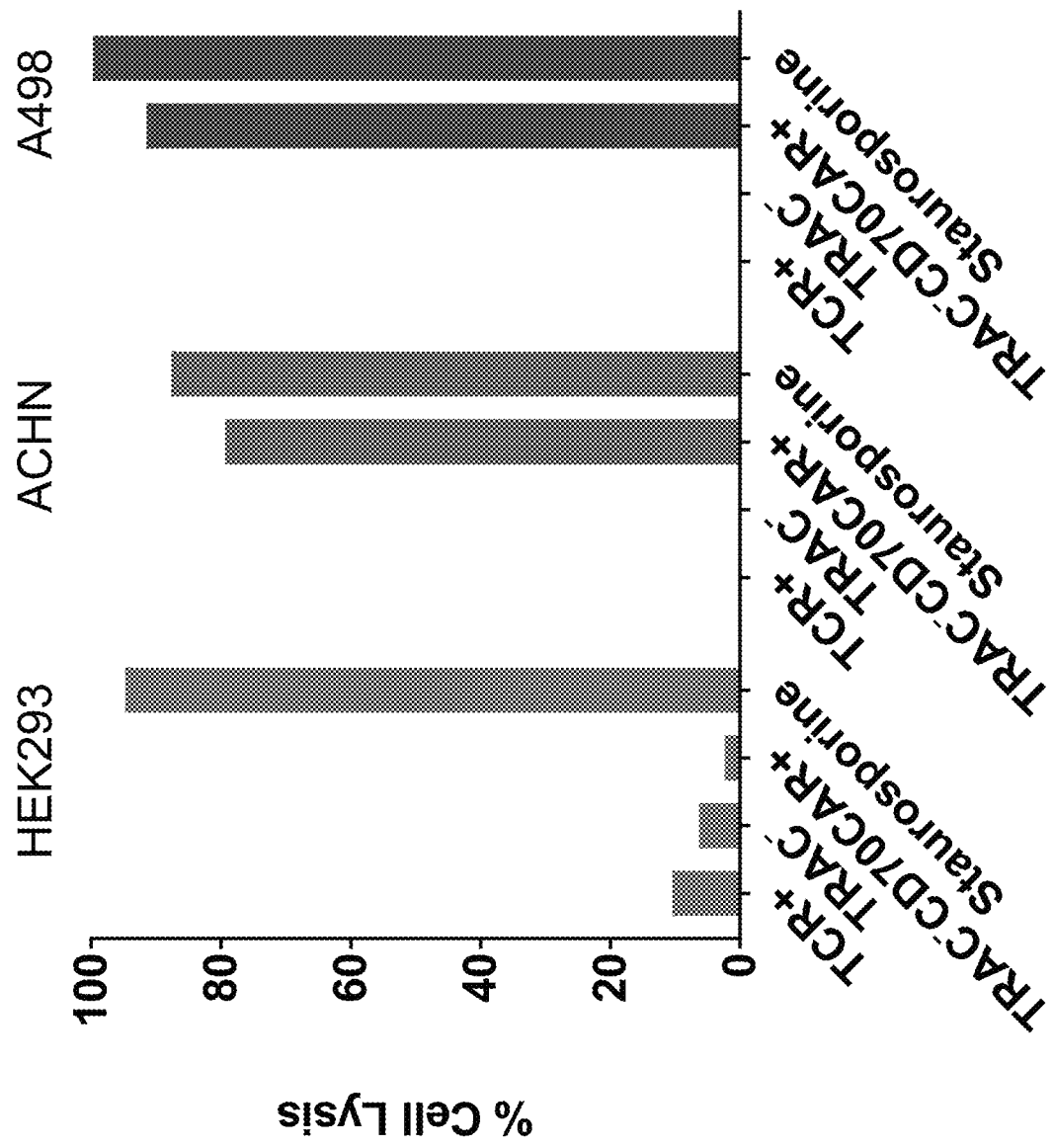
FIG. 30A is a graph of cell killing data demonstrating CD70 specific cell killing.
Figure 30C:
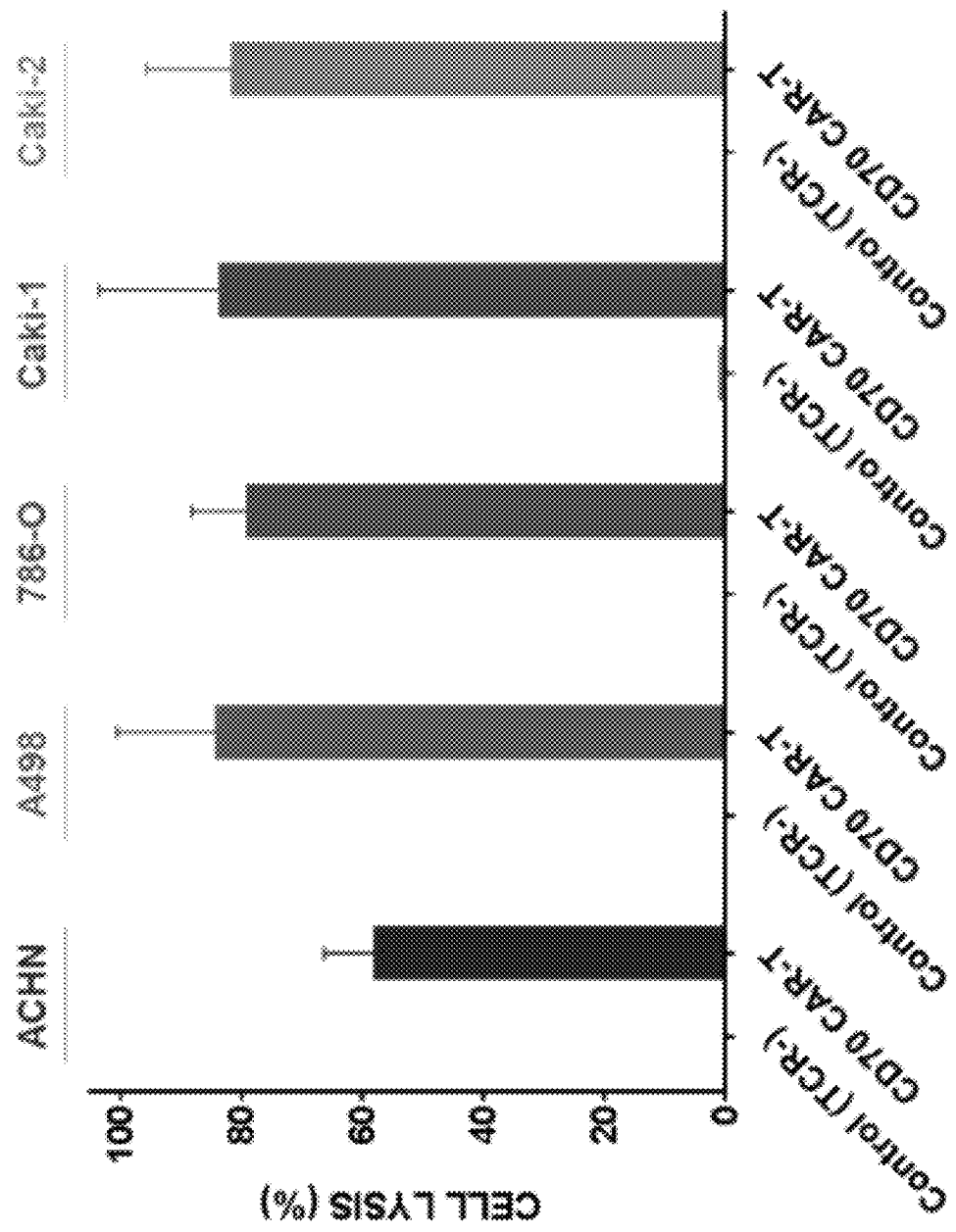
FIG. 30C is a graph demonstrating that TCR-deficient anti-CD70 CAR-T cells (CD70 CAR+) display cell killing activity against a panel of RCC cell lines with varying CD70 expression (24 hour time point), as compared to TCR-cells (control).

To assess the ability of CRISPR/Cas9 modified T cells expressing a CD70 CAR to kill CD70 expressing adherent renal cell carcinoma (RRC) derived cell lines, a cell killing assay was devised. Adherent cells were seeded in 96-well plates at 50,000 cells per well and left overnight at 37° C. The next day T cells were added to the wells containing target cells at a 2:1 ratio. After the indicated incubation period, T cells were removed from the culture by aspiration and 100 µL Cell titer-Glo (Promega) was added to each well of the plate to assess the number of remaining viable cells. The amount of light emitted per well was then quantified using a plate reader. TRAC−CD70CAR+ cells induced potent cell killing of renal cell carcinoma derived cell lines after a 72 hr co-incubation (FIG. 30A), while control test cells (control T cells: TCR+ or TRAC−) had no effect. As expected, the TRAC−CD70CAR+ cells did not exhibit any ability to lyse a CD70 negative human embryonic kidney derived cell line (HEK293 or 293). Staurosporine (Tocris) was used as a positive control to show that the levels of cell killing induced by a small molecule was comparable between the 3 target cell types tested. These results demonstrate that cell lysis induced by TRAC−CD70CAR+ cell is specific toward target cells expressing surface CD70. In addition, CRISPR/Cas9 modified T cells expressing a CD70 CAR exhibited potent cell lysis of a series of CD70 expressing renal cell carcinoma derived cell lines (FIGS. 30B and 30C).

Evaluation of Costimulatory Domains 41Bb and CD28 in Anti-CD70 CAR T Cells

Figure 61:
FIG. 61 is a schematic of CTX-145b (SEQ ID NO: 1360), which includes an anti-CD70 CAR having a 4-1BB co-stimulatory domain flanked by left and right homology arms to the TRAC gene.

CTX145b (SEQ ID NO: 1360) is derived from CTX145 where CD28[co-stimulatory domain] has been replaced by 41BB[co-stimulatory domain] (FIG. 61). The 4-1BB domain sequence is (nucleotide-SEQ ID NO: 1339)
AAACGGGGCAGAAAGAAACTCCTGTATATATTCAAACAACCATTTATGAG
ACCAGTACAAACTACTCAAGAGGAAGATGGCTGTAGCTGCCGATTTCCAG
AAGAAGAAGAAGGAGGATGTGAACTG;

(amino acid-SEQ ID NO: 1340)
KRGRKKLLYIFKQPFMRPVQTTQEEDGCSCRFPEEEEGGCEL.

Efficient creation of TRAC, B2M Double Knockout anti-41BB-CD70 CAR-T Cells

This example demonstrates efficient transgene insertion and concurrent gene knockout by Cas9:sgRNA RNP (for double-stranded break induction) and AAV6 delivered donor template (CTX-145b (SEQ ID NO: 1360)) containing a CD70 CAR construct in primary human T cells. The production of allogenic human T cells is as described in Example 16. The high efficiency is similar when using AAV6 delivered donor template CTX-145 (SEQ ID NO: 1359) and CTX145b (89.7% CAR+ cells using CTX-145 v. 88.6% CAR+ cells using CTX-145b, compared to 2.38% CAR+ cells with control (no donor template)).

Figure 62:
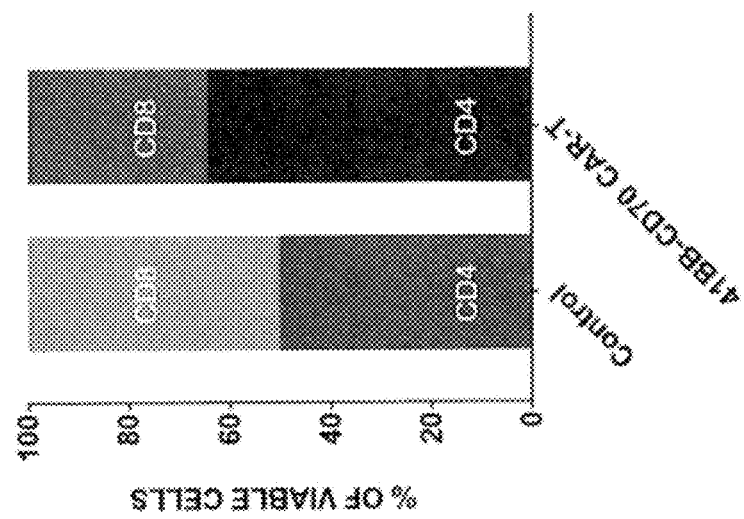
FIG. 62 is a graph showing that normal proportions of CD4+/CD8+ T cell subsets maintin the TRAC−/B2M−/anti-CD70 CAR+ fraction from cells treated with TRAC and B2M sgRNA-containing RNPs and CTX 145b AAV6.

FIG. 62 demonstrates normal proportions of CD4/CD8 T cell subsets maintained in the TRAC−/B2M−/anti-CD70(4-1BB co-stim) CAR+ fraction from cells treated with TRAC and B2M sgRNA containing RNPs and CTX-145b AAV6, suggesting that the expression of a genetically engineered T cells expressing an anti-CD70 CAR that has a 4-1BB co-stimulatory domain does not affect significantly the proportion of T cell subsets.

Efficient production of PD1, TRAC, B2M Triple Knockout anti-CD70 CAR-T Cells, with a 4-1BB or a CD28 Costimulatory Domain This example demonstrates efficient transgene insertion and concurrent gene knockout by Cas9:sgRNA RNP (for double stranded break induction) and AAV6 delivered donor template (CTX-145 or CTX-145b) containing an anti-CD70 CAR construct in primary human T cells. The production of allogenic human T cells is as described in Example 24, where CTX-138 was replaced by CTX-145 (CD28 co-stim) or CTX-145b (4-1BB co-stim).

Figure 63:
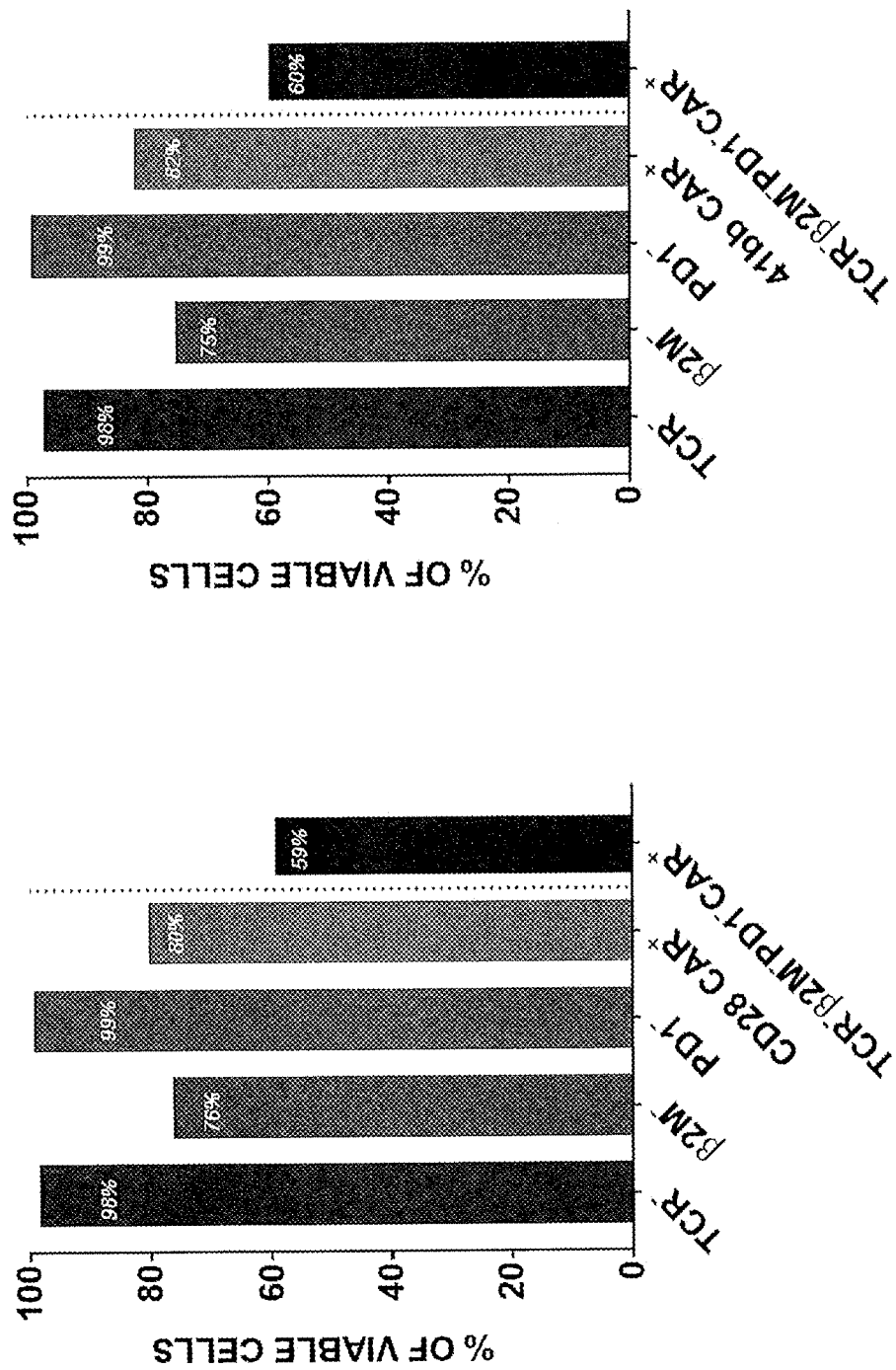
FIG. 63 are graphs demonstrating efficient transgene insertion and concurrent gene knockout by Cas9:sgRNA RNP and AAV6 delivered donor template (CTX-145 and CTX-145b) containing an anti-CD70 CAR construct in primary human T cells.

The high efficiency was similar when using AAV6-delivered donor template (compare CTX-145 and CTX145b) (FIG. 63). 80% of the engineered T cells expressed the anti-CD70 CAR having the CD28 co-stim domain, wherein 82% expressed the anti-CD70 CAR having the 4-1BB co-stim domain.

Figure 64:
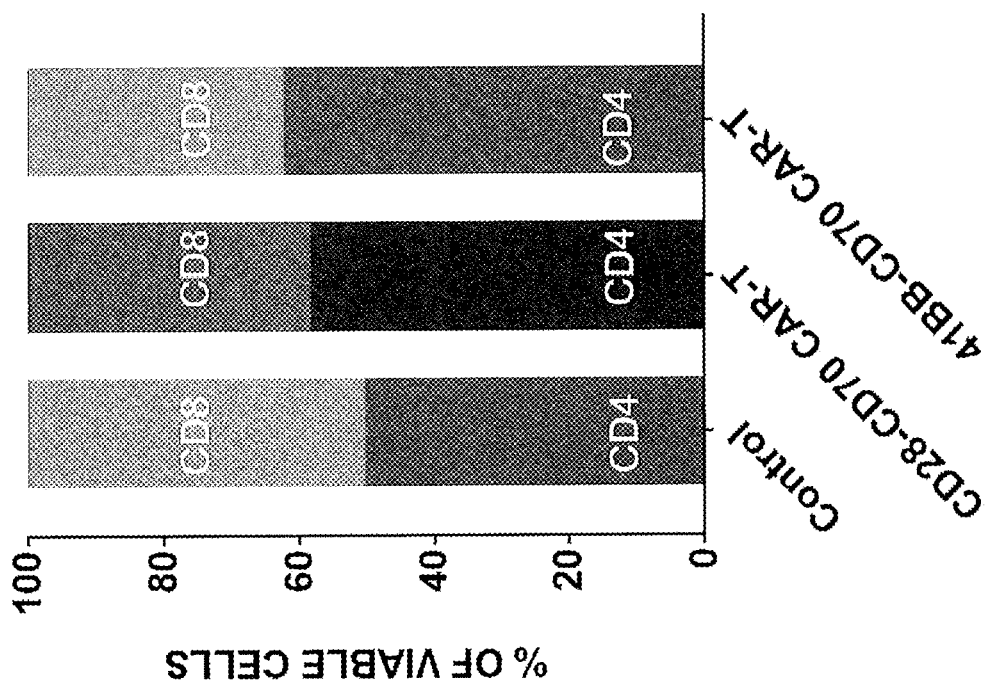
FIG. 64 is a graph demonstrating that normal proportions of CD4+/CD8+ T cell subsets are maintained in the PD1−/TRAC−/B2M−/anti-CD70 CAR+ fraction from cells treated with PD1, TRAC and B2M sgRNA-containing RNPs and CTX-145b AAV6.

FIG. 64 shows that normal proportions of CD4/CD8 T cell subsets were maintained in the PD1−/TRAC−/B2M−/anti-CD70 CAR+ fraction from cells treated with PD1, TRAC and B2M sgRNA containing RNPs and CTX-145b AAV6, suggesting that expression of an anti-CD70 CAR that has a 4-1BB co-stimulatory domain in genetically engineered T cells does not affect significantly the proportion of T cell subsets.

Cell Kill Assay in Adherent Renal Cell Carcinoma

Figure 65:
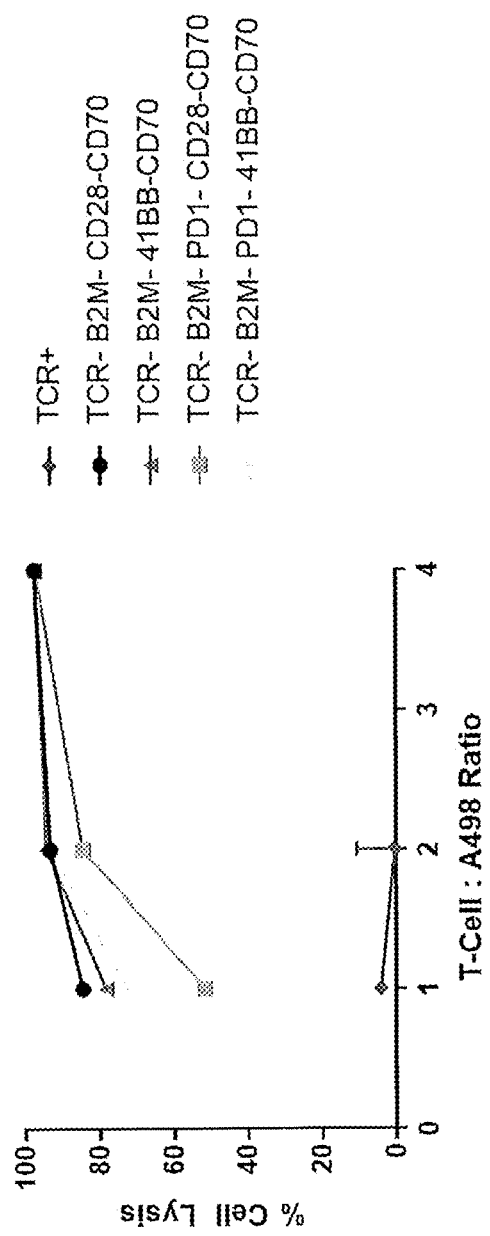
FIG. 65 is a graph showing that TRAC−/B2M−/andti-CD70 CAR+ cells demonstrated potent cell killing of renal cell carcinoma derived cell lines (A498 cells) after 24 hours co-incubation.

To assess the ability of CRISPR/Cas9 modified T cells expressing an anti-CD70 CAR to kill CD70 expressing adherent renal cell carcinoma (RRC) derived cell lines, a cell killing assay was devised as described above. TRAC−/B2M−/anti-CD70 CAR+ cells demonstrated potent cell killing of renal cell carcinoma derived cell lines (A498 cells) after 24 hours co-incubation (FIG. 65), in the context of both costimulatory domains CD28 and 41BB, compared to control test cells (control T cells: TCR+). PD1−/TRAC−/B2M−/anti-CD70 CAR+ cells induced similar potent cell killing of A498 cells with the 4-1BB costimulatory domain (compared to double KO cells), but lower potency with CD28 costimulatory domain (FIG. 65).

Figure 66:
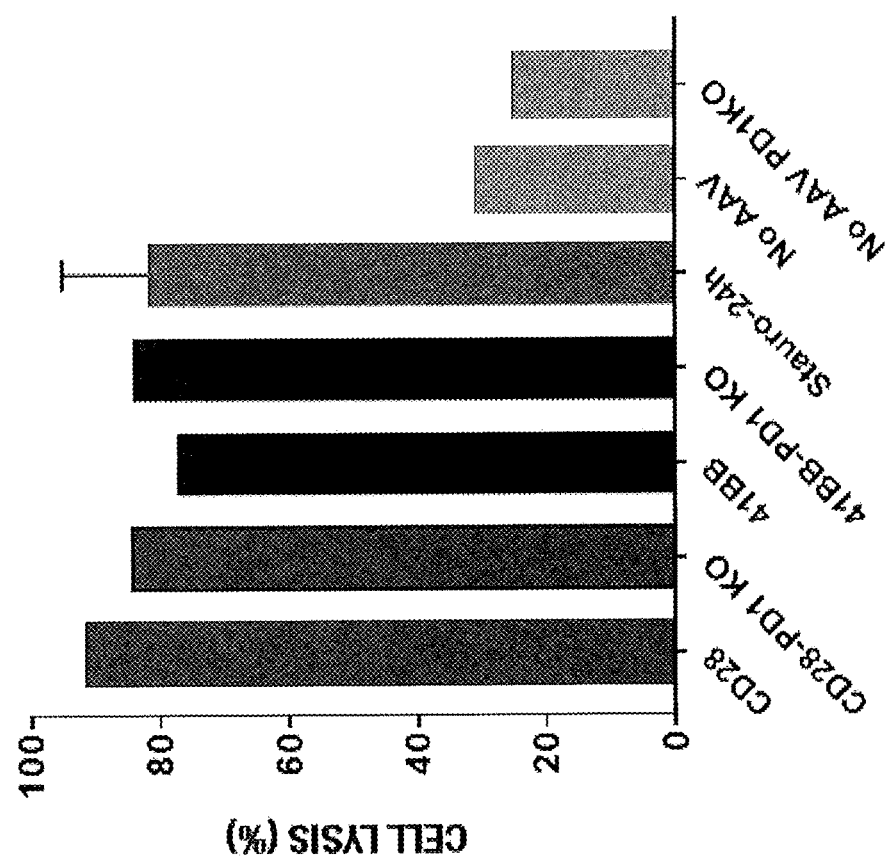
FIG. 66 is a graph showing that TRAC−/B2M−/anti-CD70 CAR+ cells and PD1−/TRAC−/B2M−/anti-CD70 CAR+ cells induced potent cell killing of CD70 expressing adherent renal cell carcinoma (RRC) derived cell line, ACHN, with a CD28 or 41BB costimulatory domain, at a 3:1 ratio T cell: target cell.

FIG. 66 shows that TRAC−/B2M−/anti-CD70 (4-1BB or CD28) CAR+ cells and PD1−/TRAC−/B2M−/anti-CD70 (4-1BB or CD28) CAR+ cells induced potent cell killing of CD70 expressing adherent renal cell carcinoma (RRC) derived cell line, ACHN at a 3:1 ratio T cell: target cell.

Example 19—Anti-BCMA CAR T Cells

CRISPR/Cas9 Mediated Knockout of TCR and MHC I Components and Expression of BCMA Chimeric Antigen Receptor Constructs This example describes the production by CRISPR/Cas9 and AAV6 of allogeneic human T cells that lack expression of TCR, or TCR and MHC I, and express a chimeric antigen receptor targeting BCMA+ cancers.

Figure 31A:
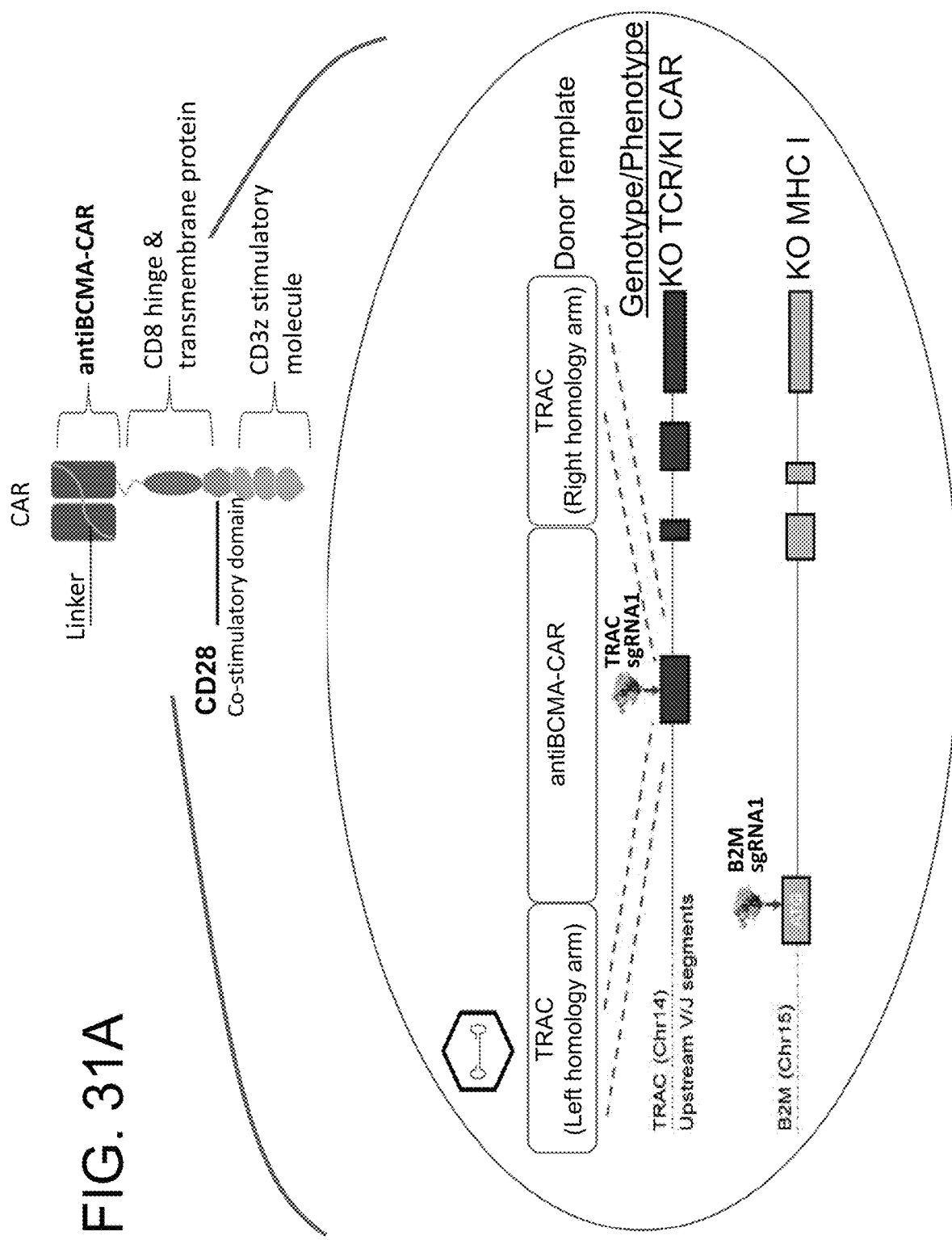
FIG. 31A is a graphical depiction of a CAR-T cell that lacks MHC-I expression produced by CRISPR/Cas9/sgRNAs and AAV6 delivered donor templates. This depiction shows knockout of the TRAC gene with knock-in of a CAR construct into the TRAC locus (mediated by HDR). This depiction also shows deletion of sites in the B2M gene.

A schematic depiction of CRISPR/Cas9 generated allogeneic CAR-T cells is shown in FIG. 31A.

Similar to Example 9 and 15 above, CRISPR/Cas9 was used to disrupt (knockout [KO]) the coding sequence of the TCRa constant region gene (TRAC). This disruption leads to loss of function of TCR and renders the gene edited T cell non-alloreactive and suitable for allogeneic transplantation, minimizing the risk of graft versus host disease (GVHD). The DNA double stranded break at the TRAC locus was repaired by homology directed repair with an AAV6-delivered DNA template containing right and left homology arms to the TRAC locus flanking a chimeric antigen receptor cassette (−/+ regulatory elements for gene expression). To reduce host versus graft (HVG) (e.g.: host vs CAR-T) and allow for persistence of the allogeneic CAR-T product, the B2M gene was also disrupted using CRISPR/Cas9 components. Together, these genome edits result in a T cell with surface expression of a CAR (expressed from the TRAC locus) targeting BCMA+ cancers along with loss of the TCR and MHC I, to reduce GVHD and HVG, respectively. The T cell can be referred to as a TRAC−/B2M−/anti-BCMA CAR+ cell.

For certain experiments, described in the following examples, single knock-out TRAC-BCMA CAR+ cells were also produced and tested.

Figure 31B:
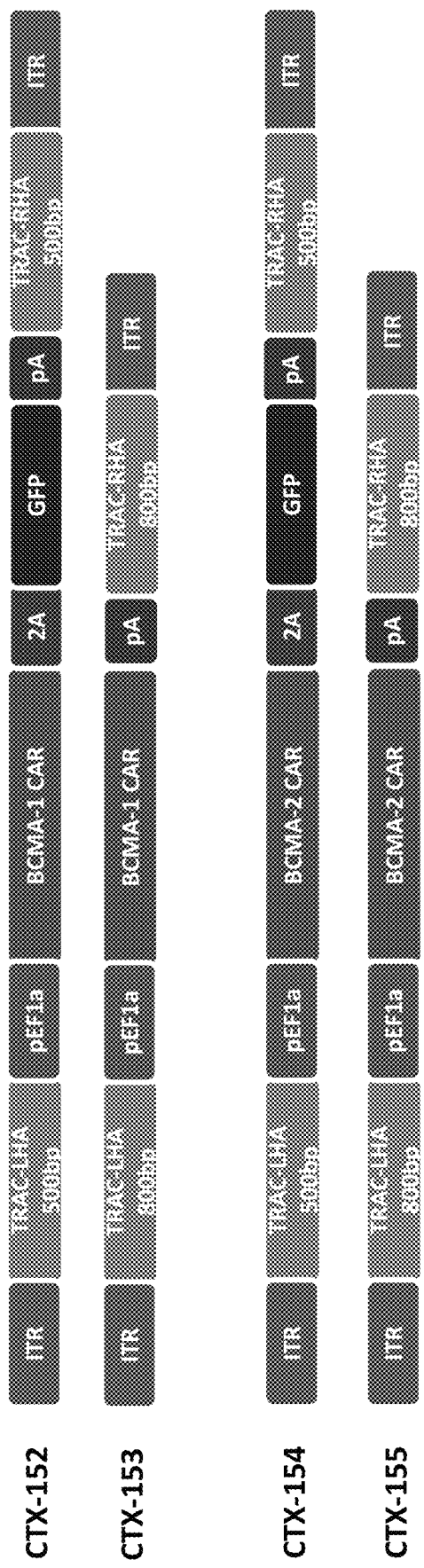
FIG. 31B is a schematic representation of AAV constructs used in production of AAV virus for delivery of donor DNA templates for repair of Cas9 induced double stranded breaks and site-specific transgene insertion. Schematic design of the anti-BCMA CAR AAV donor template. Both CTX152 and CTX154 were designed to co-express the CAR and Green fluorescent protein (GFP) from a bicistronic mRNA. CTX-152 CAR=VH-VL; CTX-154 CAR=VL-VH.

A schematic of DNA plasmid constructs for production of recombinant AAV virus carrying donor templates to facilitate targeted genomic insertion of CAR expression cassettes by HDR of Cas9-evoked site specific DNA double stranded breaks is shown in FIG. 31B.

TABLE 23

Donor Template Component Sequences

| SEQ ID NO: | Domain Name | Length (bp) |
|---|---|---|
| 1313 | Left ITR (5' ITR) | 145 |
| 1314 | Right ITR (3' ITR) | 145 |
| 1425 | BCMA-1 CAR | 1512 |
| 1426 | BCMA-2 CAR | 1512 |
| 1317 | 2A | 66 |
| 1318 | EGFP | 720 |
| 1319 | pA | 49 |
| 1325 | TRAC-LHA (800 bp) | 800 |
| 1326 | TRAC-RHA (800 bp) | 804 |
| 1331 | EF1a | 1178 |

CTX-153 (SEQ ID NO: 1362) and CTX-155 (SEQ ID NO: 1364) are derived from CTX-145 but with the anti-CD70 scFv coding region of CTX-145 is replaced with anti-human BCMA scFv coding region (FIG. 31B and FIG. 14). CTX-152 (SEQ ID NO: 1361) and CTX-154 (SEQ ID NO: 1363) differs from CTX-153 and CTX-155, respectively, by the addition of the picornavirus 2A and GFP sequences. CTX-152, CTX-153, CTX-154, and CTX-155, all contain homology arms flanking a genomic Cas9/sgRNA target site in the TRAC locus. CTX-152 and CTX-153 contain 800 bp homology arms, while CTX-154 (SEQ ID NO: 1363) and CTX-155 contain 500 bp homology arms (FIG. 31B). CTX-152 (SEQ ID NO: 1361) and CTX-154 differ from each other in the orientation of the anti-BCMA scFv variable heavy (VH) and variable light (VL) chains. CTX-152 (SEQ ID NO: 1361) contains an anti-BCMA CAR construct (anti-BCMA (nucleotide sequence (SEQ ID NO: 1425); amino acid sequence (SEQ ID NO: 1451)): CD8 [signal peptide]-VH-linker-VL-CD8[tm]-CD28[co-stimulatory domain]-CD3z) with a synthetic 3' poly adenylation sequence (pA) whose expression is driven by the EF1a promoter. The scFv is constructed such that the VH chain is amino terminal to the VL chain. CTX-154 is similar to CTX-152, however the anti-BCMA CAR construct (contains an anti-BCMA CAR construct (anti-BCMA (nucleotide sequence (SEQ ID NO: 1426); amino acid sequence (SEQ ID NO: 1452): CD8[signal peptide]-VL-linker-VH-CD8[tm]-CD28[co-stimulatory domain]-CD3z) switched the orientation of the VH and VL chains, the VL is animo terminal to the VH.

The VH and VL chains that were used to construct the anti-BCMA scFvs are BCMA_VH1 (SEQ ID NO: 1523) and BCMA_VL1 (SEQ ID NO: 1525), respectively. These chains were derived from mouse antibodies. A humanized version of the VH sequence have been constructed (SEQ ID NO: 1524) and two humanized versions of the VL sequence have been constructed (SEQ ID NOs: 1526 and 1527). These were used to construct humanized anti-BCMA constructs scFv BCMA-3, scFv BCMA-4, scFv BCMA-5 and scFv BCMA-6 (SEQ ID NOs: 1503-1506) using the method described above. Any one of these scFvs can be used to construct CAR constructs as described previously. The humanized scFv CAR constructs have the linker sequence of GGGGSGGGGSGGGGS (SEQ ID NO: 1341).

Additional anti-BCMA scFvs were constructed using the method described above. For example, VH and VL chains BCMA_VH2 (SEQ ID NO: 1528) and BCMA_VL2 (SEQ ID NO: 1529) can be used to construct anti-BCMA scFvs. These variable chains were used to construct the anti-BCMA constructs scFv BCMA-7 (VH-VL; SEQ ID NO: 1507) and scFv BCMA-8 (VL-VH; SEQ ID NO: 1508). Any one of these scFvs can be used to construct CAR constructs as described previously.

In another example, the VH and VL chains BCMA_VH3 (SEQ ID NO: 1530) and BCMA_VL3 (SEQ ID NO: 1531) were used to construct anti-BCMA scFvs. Specifically, these variable chains were used to construct the anti-BCMA constructs scFv BCMA-9 (VH-VL; SEQ ID NO: 1513) and scFv BCMA-10 (VL-VH; SEQ ID NO: 1514). Any one of these scFvs can be used to construct CAR constructs as described previously. Anti BCMA CAR T cells were produced with CRISPR/Cas9 and AAV components as described (herein). Transgene insertion in primary human T cells via homology directed repair (HDR) and concurrent gene knockout by Cas9:sgRNA RNA was performed as described above in Examples 8 and 9. Primary human T cells were first electroporated with Cas9 or Cas9:sgRNA RNP complexes targeting TRAC (AGAGCAACAGTGCTGTG-GCC (SEQ ID NO: 76); sgRNA (SEQ ID NO: 1343) and B2M1 (GCTACTCTCTCTTTCTGGCC (SEQ ID NO: 417); sgRNA (SEQ ID NO: 1345).

sgRNA sequences can be modified as follows: TRAC SEQ ID NO: 1342, B2M SEQ ID NO: 1344.

The DNA double stranded break at the TRAC locus was repaired by homology directed repair with an AAV6-delivered DNA template (CTX-152, or CTX-154).

High Efficiency Multi-Editing by CRISPR/Cas9 to Produce Anti-BCMA CAR-T Cells

Figure 58A:
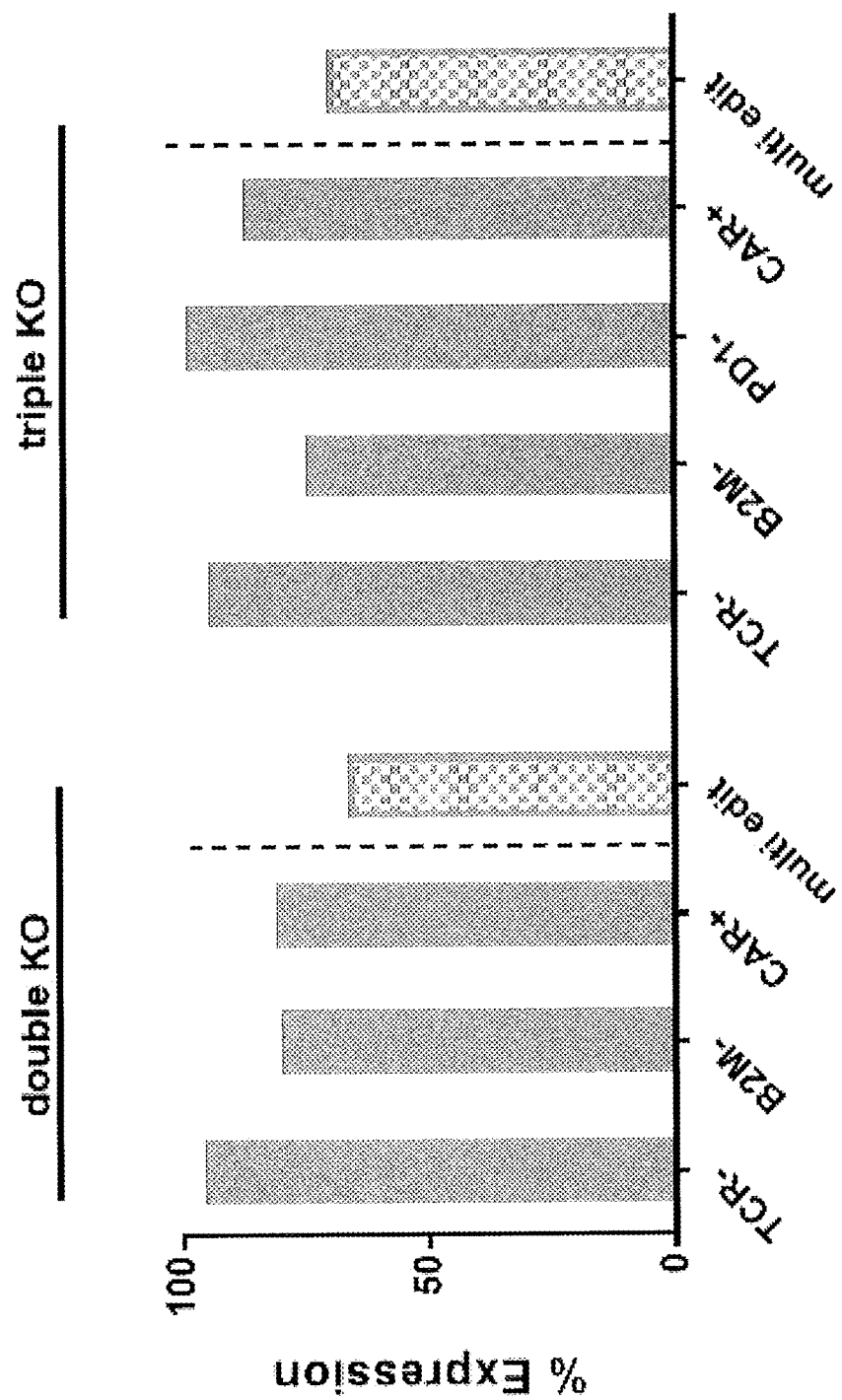
FIG. 58A is a graph showing that multi-editing results in decreased surface expression of TCR and MHC-I, as well as high CAR expression.

Multi-editing resulted in decreased surface expression of TCR and MHC-I, as well as high CAR expression. More than 60% T-cells possessed all three (TCR–/β2M–/anti-BCMA CAR+) or four (TCR–/β2M–/PD1–/anti-BCMA CAR+) desired modifications (FIG. 58A). Similar editing efficiencies were observed with double or triple knockouts.

Figure 59A:
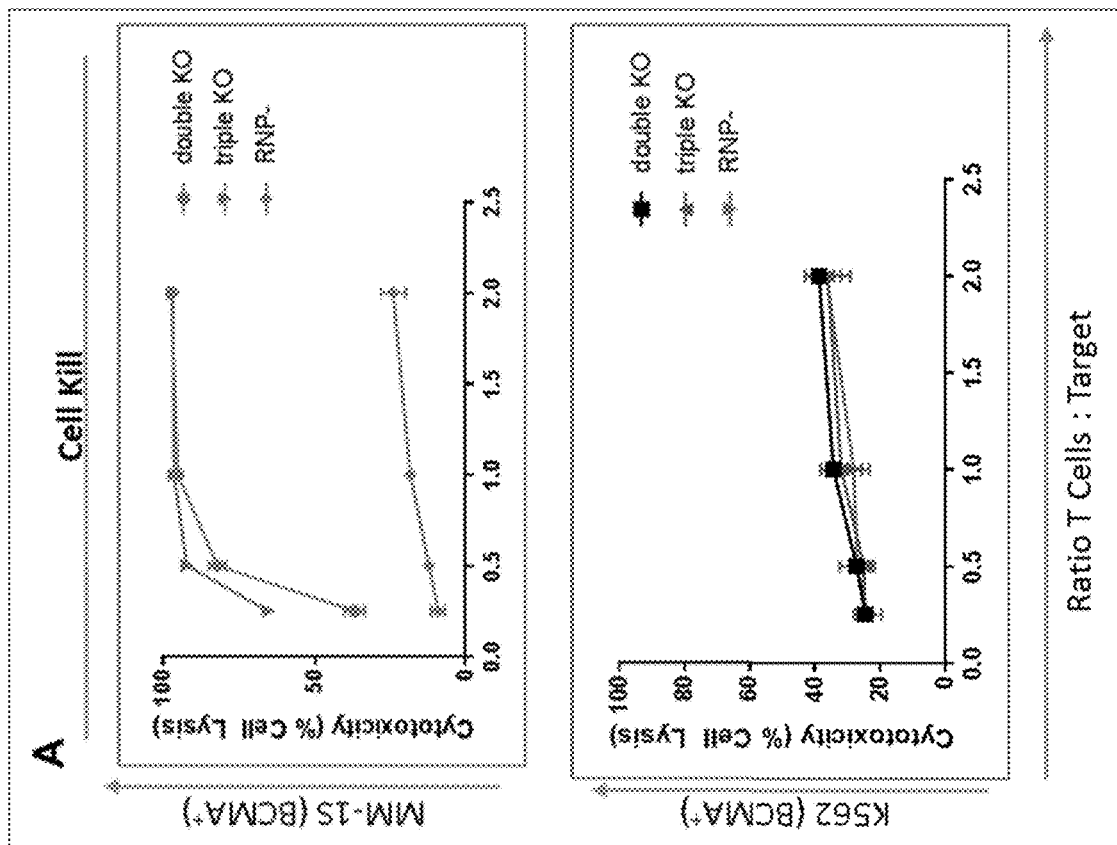
FIG. 59A are graphs showing that anti-BCMA CAR-T cells efficiently and selectively kill the BCMA-expressing MM cell line MM.1S in a 4-hour cell kill assay, while sparing the BCMA-negative leukemic line K562.
Figure 59B:
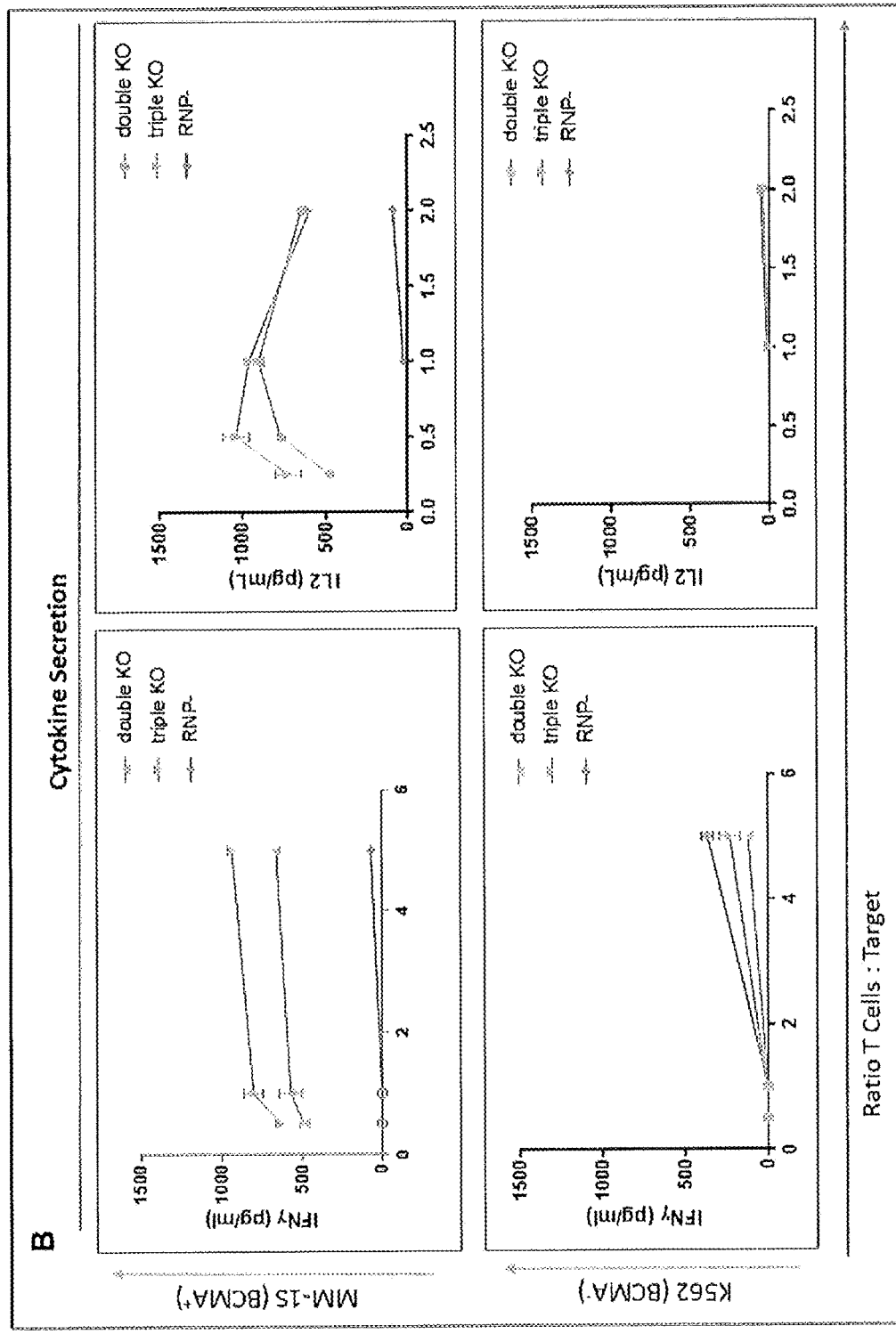
FIG. 59B are graphs showing that the cells also selectively secrete the T cell activation cytokines IFNγ and IL-2, which are upregulated in response to induction only by BCMA+ MM.1S cells.
Figure 60:
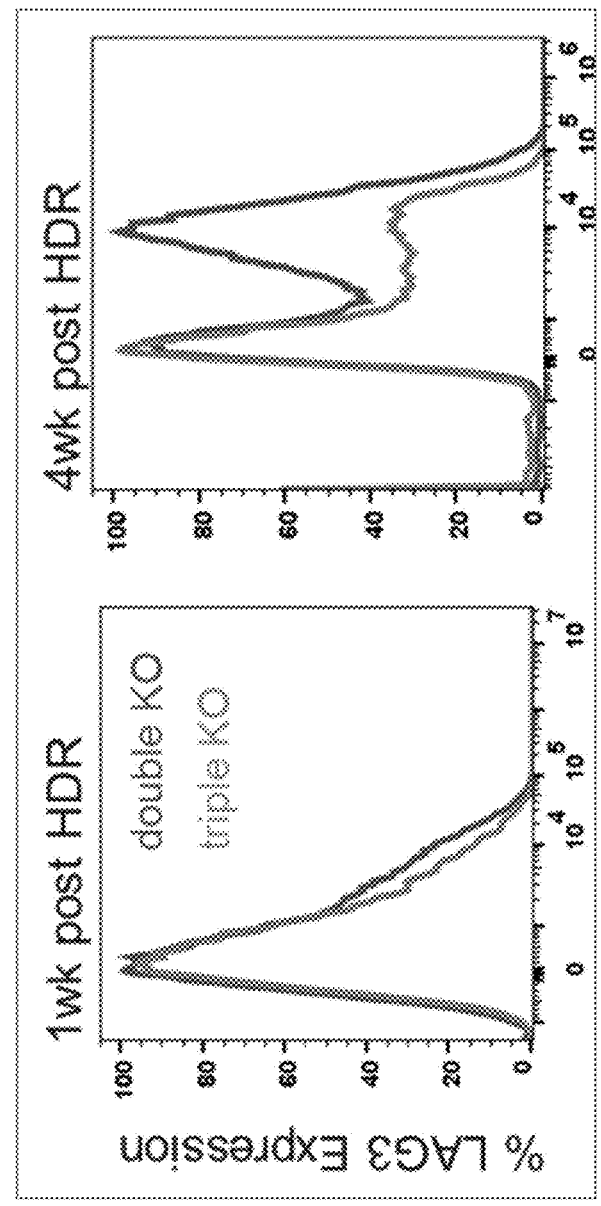
FIG. 60 is a graph showing no observed change in Lag3 exhaustion marker between double or triple knockout (KO) anti-BCMA CAR-T cells after 1 week in culture. However, following 4 weeks in culture, Lag3 exhaustion marker expression was reduced in the triple KO anti-BCMA CAR-T cells.

K562 (FIG. 59A). Differences in response were notable at the lower T cell concentrations between double and triple knockout multi-edits. The cells also selectively secreted the T cell activation cytokines, IFNγ and IL-2, which are upregulated in response to induction only by BCMA+ MM.1S cells (FIG. 59B).

PD1 KO Reduces Expression of Lag3 Exhaustion Marker in Long-term In Vitro Culture No change in Lag3 exhaustion marker was observed between double (TCR–/β2M–/anti-BCMA CAR+) or triple (TCR–/β2M–/PD1–/anti-BCMA CAR+) KO anti-BCMA CAR-T cells after 1 week in culture. However, following four (4) weeks in culture, Lag3 expression was reduced in the triple KO anti-BCMA CAR-T cells indicating that the cells with the PD1 KO were less exhausted.

TABLE 24

Example BCMA Constructs

| Constructs* | Construct SEQ ID NO: (nucleic acid) | Donor Template (nucleic acid) LHA to RHA | CAR SEQ ID NO: (nucleic acid) | CAR SEQ ID NO: (amino acid) | scFv SEQ ID NO: (nucleic acid) | scFv SEQ ID NO: (amino acid) |
|---|---|---|---|---|---|---|
| CTX-152 | 1361 | 1397 | 1425 | 1451 | 1477 | 1501 |
| CTX-153 | 1362 | 1398 | 1425 | 1451 | 1477 | 1501 |
| CTX-154 | 1363 | 1399 | 1426 | 1452 | 1478 | 1502 |
| CTX-155 | 1364 | 1400 | 1426 | 1452 | 1478 | 1502 |
| CTX-160 | 1365 | 1401 | 1427 | 1453 | 1479 | 1503 |
| CTX-161 | 1367 | 1403 | 1429 | 1455 | 1480 | 1504 |
| CTX-162 | 1368 | 1404 | 1430 | 1456 | 1481 | 1505 |
| CTX-163 | 1369 | 1405 | 1431 | 1457 | 1482 | 1506 |
| CTX-164 | 1370 | 1406 | 1432 | 1458 | 1483 | 1507 |
| CTX-165 | 1371 | 1407 | 1433 | 1459 | 1484 | 1508 |
| CTX-166 | 1372 | 1408 | 1434 | 1460 | 1485 | 1509 |
| CTX-167 | 1374 | 1410 | 1436 | 1462 | 1486 | 1510 |
| CTX-168 | 1375 | 1411 | 1437 | 1463 | 1487 | 1511 |
| CTX-169 | 1376 | 1412 | 1438 | 1464 | 1488 | 1512 |
| CTX-170 | 1377 | 1413 | 1439 | 1465 | 1489 | 1513 |
| CTX-171 | 1378 | 1414 | 1440 | 1466 | 1490 | 1514 |
| CTX-172 | 1379 | 1415 | 1441 | 1467 | 1491 | 1515 |
| CTX-173 | 1380 | 1416 | 1442 | 1468 | 1492 | 1516 |
| CTX-174 | 1381 | 1417 | 1443 | 1469 | 1493 | 1517 |
| CTX-175 | 1382 | 1418 | 1444 | 1470 | 1494 | 1518 |
| CTX-176 | 1383 | 1419 | 1445 | 1471 | 1495 | 1519 |
| CTX-177 | 1384 | 1420 | 1446 | 1472 | 1496 | 1520 |
| CTX-178 | 1385 | 1421 | 1447 | 1473 | 1497 | 1521 |
| CTX-179 | 1386 | 1422 | 1448 | 1474 | 1498 | 1522 |

Figure 58B:
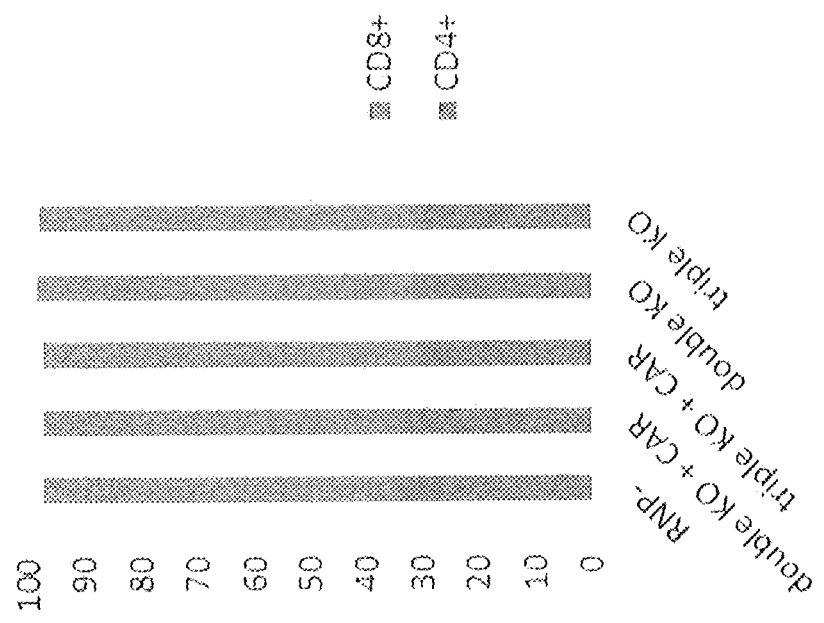
FIG. 58B is a graph showing that CD4/CD8 ratios remain similar in multi-edited anti-BCMA CAR-T cells.
Figure 58C:
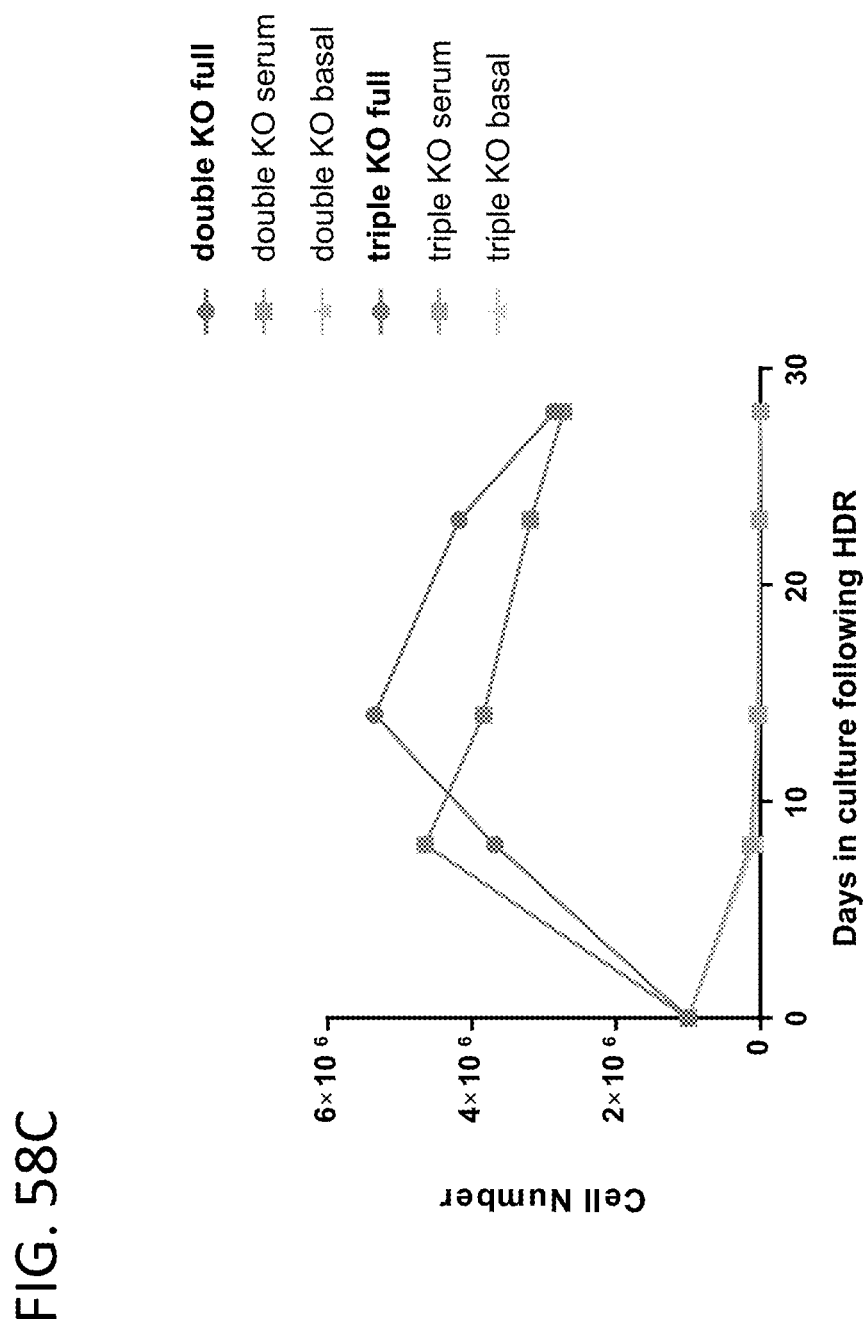
FIG. 58C is a graph showing that multi-edited anti-BCMA CAR-T cells remain dependent on cytokines for growth following multi CRISPR/Cas9 editing.

The CD4/CD8 ratios remained similar in multi-edited anti-BCMA CAR-T cells (FIG. 58B). Multi-edited anti-BCMA CAR-T cells remained dependent on cytokines for growth following multi-CRISPR/Cas9 editing (FIG. 58C).

The following gRNA spacer sequences were used in this example:

```
                            (SEQ ID NO: 152)
TRAC:    AGAGCAACAGUGCUGUGGCC (SEQ ID NO: 466)
B2M:     GCUACUCUCUCUUUCUGGCC (SEQ ID NO: 1086)
PD1:     CUGCAGCUUCUCCAACACAU
```

The donor template used in this example was SEQ ID NO: 1408 (LHA to RHA of CTX-166), which includes the anti-BCMA CAR comprising SEQ ID NO: 1434.

Multi-Edited Anti-BCMA CAR-T Cells Show Improved Anti-Cancer Properties

Anti-BCMA CAR-T cells efficiently and selectively killed the BCMA-expressing MM cell line MM.1S in a 4-hour cell kill assay, while sparing the BCMA-negative leukemic line It should be understood that for any one of the constructs provided in Table 24, the scFv fragment of the CAR may be substituted with any other scFv fragment listed in Table 24.

Example 20—HDR-Mediated Concurrent Transgene Insertion in Cells to Tenerate TRAC–B2M–BCMA CAR+ Cells This example demonstrates efficient transgene insertion and concurrent gene knockout by Cas9:sgRNA RNP (for double stranded break induction) and AAV6 delivered donor template (CTX-152 or CTX-154) containing a BCMA CAR construct in primary human T cells.

Primary human T cells were activated with CD3/CD28 magnetic beads (as described previously in Example 2). Three days later activation beads were removed. The next day cells were electroporated with RNP complexes including sgRNAs targeting TRAC or B2M (2 separately complexed RNPs). 7 days post manipulation, cells were analyzed by flow cytometry, as previously described herein and in Example 2.

Guides used in this example target:

```
(SEQ ID NO: 76)
TRAC: AGAGCAACAGTGCTGTGGCC;
and comprise TRAC sgRNA (SEQ ID NO: 686)

(SEQ ID NO: 417)
B2M: GCTACTCTCTCTTTCTGGCC;
and comprise B2M sgRNA (SEQ ID NO: 688)
```

The gRNAs used in this Example comprise the following spacer sequences: TRAC gRNA spacer (AGAGCAACA-GUGCUGUGGCC (SEQ ID NO: 152)); and B2M gRNA spacer (GCUACUCUCUCUUUCUGGCC (SEQ ID NO: 466)).

sgRNA sequences can be modified as follows: TRAC SEQ ID NO: 1342, B2M SEQ ID NO: 1345.

FACS analysis demonstrated that 77% of T cells were TRAC−, B2M− following treatment with TRAC sgRNA contain RNP and B2M sgRNA containing RNP (FIG. 32—top panels). In addition, the gene edited cells expressed the CAR construct as evidenced by positive GFP expression and recombinant BCMA binding (FIG. 32—bottom panels).

FIG. 32 demonstrates successful production of single human T cells lacking TCR and B2M surface expression with concurrent expression of the BCMA CAR from an integrated transgene in the TRAC locus using the methods described above (TCR−/B2M− BCMA CAR+).

Example 21—Evaluation of Effector Function in CRISPR/Cas9 Modified T Cells Expressing a BCMA Chimeric Antigen Receptor (CAR)

Cell Kill Assay in BCMA Expressing Cells

To assess the ability of TRAC$^-$/B2M$^-$/anti-BCMA CAR+ T cells to kill suspension cell lines a flow cytometry based cell killing assay was designed. The TRAC$^-$/B2M$^-$/anti-BCMA CAR+ T cells (see Example 19 for Table of CARs used) were co-cultured with cells of the BCMA-expressing RPMI8226 (ATCC Cat # ATCC-155) human plasmacytoma target cell line, cells of the BCMA-expressing U-266 cell line, or cells of the K562 cell line, which do not express BCMA (collectively referred to as the "target cells". The target cells were labeled with 5 μM efluor670 (eBiosciences), washed and incubated in co-cultures with the TRAC$^-$/B2M$^-$/anti-BCMA CAR+ T cells at varying ratios (from 0.1:1 to 8:1 T cells to target cells) at 50,000 target cells per well of a U-bottom 96-well plate overnight. The next day wells were washed, media was replaced with 200 μL of media containing a 1:500 dilution of 5 mg/mL DAPI (Molecular Probes) (to enumerate dead/dying cells). Finally, 25 μL of CountBright beads (Life Technologies) was added to each well. Cells were then processed by flow cytometry.

Target cells per μL were then calculated from analyzed flow cytometry data:

Cells/μL=((number of live target cell events)/(number of bead events))×((Assigned bead count of lot (beads/50 μL))/(volume of sample))

Total target cells were calculated by multiplying cells/μL×the total volume of cells.

The percent cell lysis was then calculated with the following equation:

% Cell lysis=(1−((Total Number of Target Cells in Test Sample)/(Total Number of Target Cells in Control Sample))×100

Figure 33A:
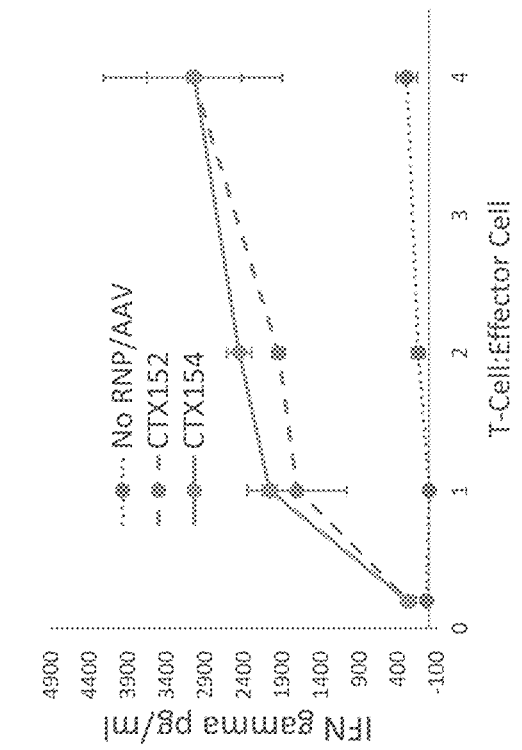
FIG. 33A is a graph showing that treatment of RPMI8226 cells that express BCMA with TRAC−/B2M− BCMA CAR-T cells results in cytotoxicity, whereas treatment with unmodified T-Cells (NO RNP/AAV) shows minimal cytotoxicity.
Figure 45A:
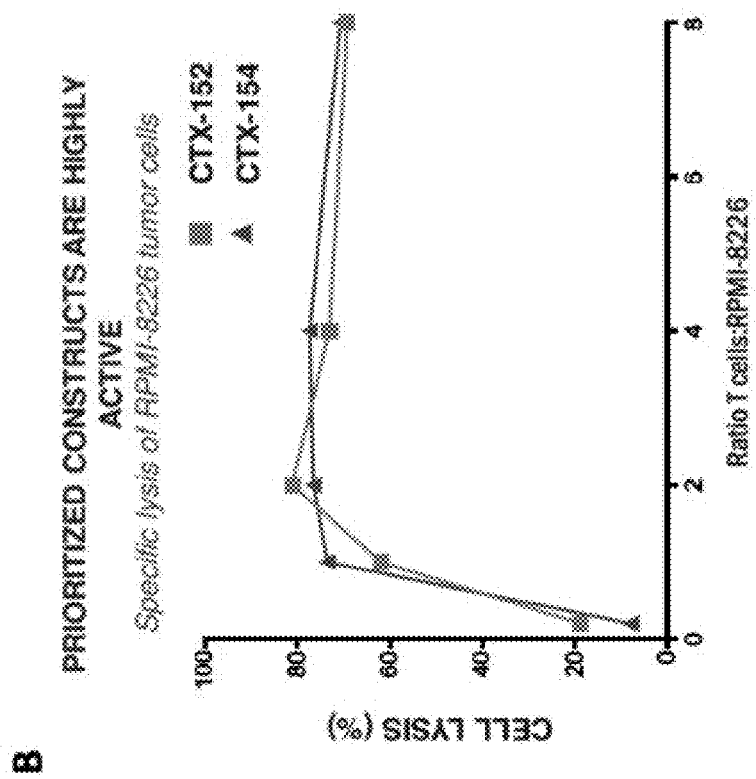
FIG. 45A is a graph showing that treatment of RPMI8226 which express BCMA, causes high levels of IFNγ secretion from TRAC−/B2M− BCMA CAR-T cells and minimal secretion from unmodified T-Cells (TCR+CAR−) (4:1 T cell:RPMI-8226 ratio). Interferon gamma was measured according to the method described in Example 18.
Figure 45B:
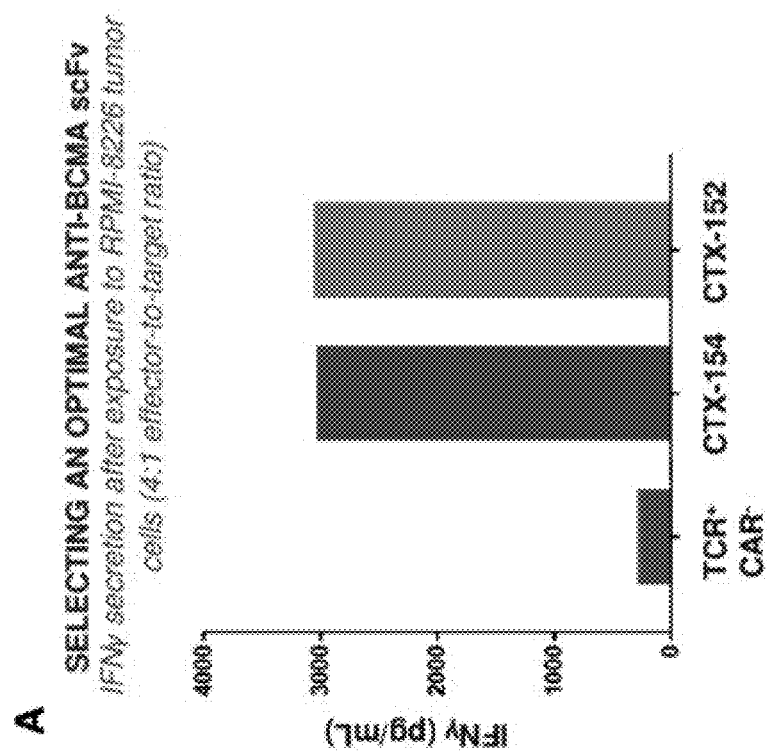
FIG. 45B is a graph showing that treatment of RPMI8226 cells which express BCMA, with TRAC−/B2M− BCMA CAR+T cells results in cell lysis and cytotoxicity.
Figure 46A:
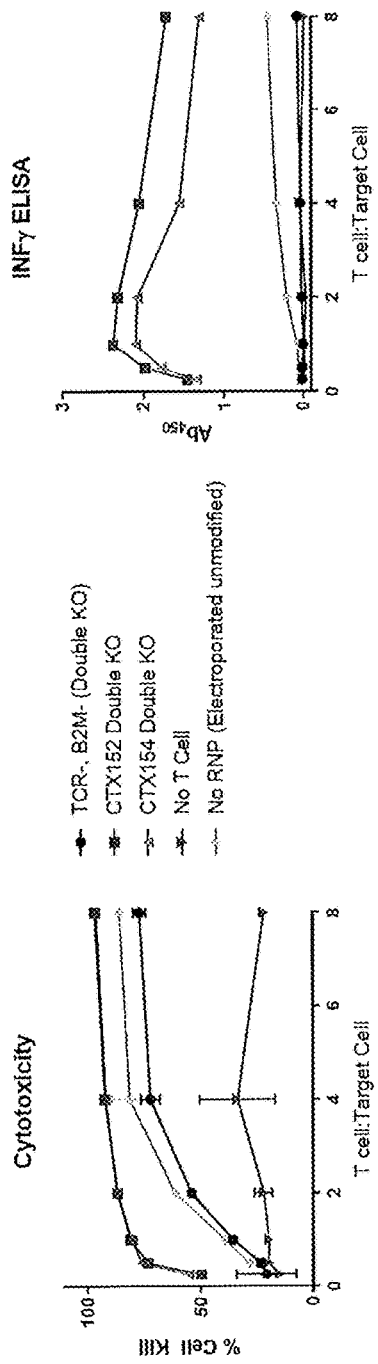
FIGS. 46A-46C are graphs of data demonstrating that anti-BCMA CAR-T cells show specific cytotoxicity towards BCMA expressing U-266 and RPMI8226 cells. Allogeneic T-Cells (TRAC−, B2M−) that expressed the CTX152 and CTX154 anti-BCMA CAR constructs express INFγ in the presence and induced lysis of U-266 (FIG. 46A) and RMPI8226 (FIG. 46B) cells while allogeneic T cells lacking the CAR and unmodified T-Cells showed minimal activity. CTX152 and CTX154 showed no specific cytotoxicity towards K562 cells that lacks BCMA expression (FIG. 46C).
Figure 46B:
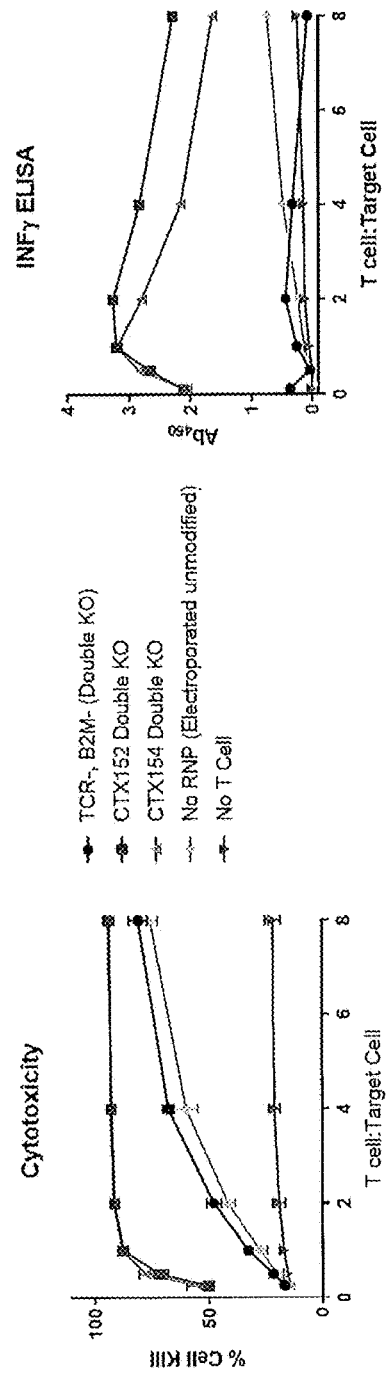
Figure 46C:
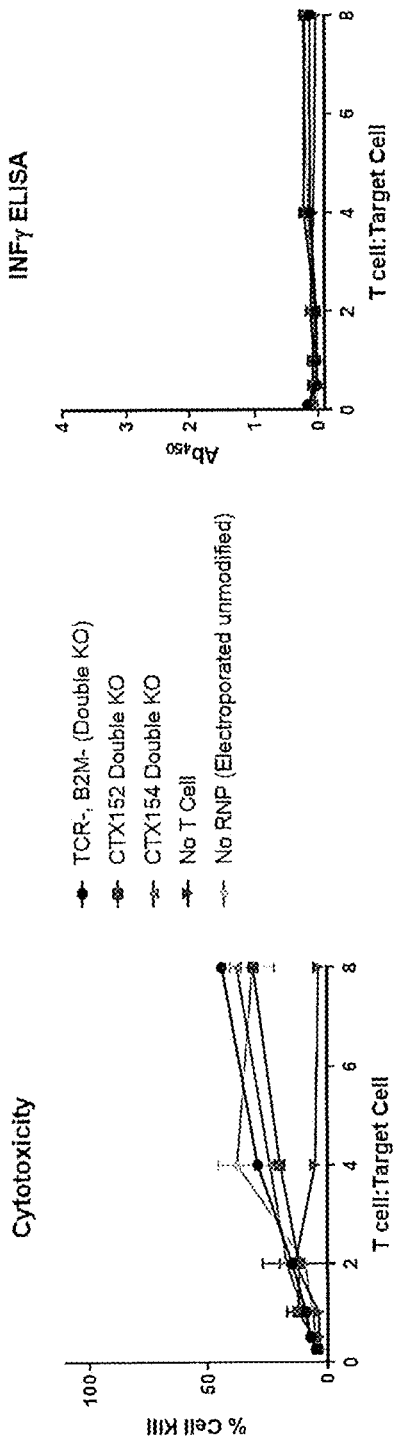

FIG. 33A, FIG. 45B, and FIG. 46B (left graph) show that TRAC−/B2M−/anti-BCMA CAR+ T cells selectively killed RPMI 8226 cells at low T cell to BCMA-expressing target cell ratios; FIG. 46A (left graph) shows that TRAC−/B2M−/anti-BCMA CAR+ T cells selectively killed U-266 cells (ATCC® TIB-196™); and FIG. 46C (left graph) shows that TRAC−/B2M−/anti-BCMA CAR+ T cells showed no specific toxicity toward K562 cells (which lack BCMA expression). The results indicate that the CRISPR/Cas9 modified T cells described herein, induce potent cell lysis in BCMA expressing plasmacytoma cell line.

Interferon Gamma Stimulation by Genetically Engineered T Cells Expressing a BCMA CAR The ability of the engineered cells to produce interferon gamma (IFNγ) in a target cell was analyzed using an ELISA assay, as described above and in Example 10 and 18.

Figure 33B:
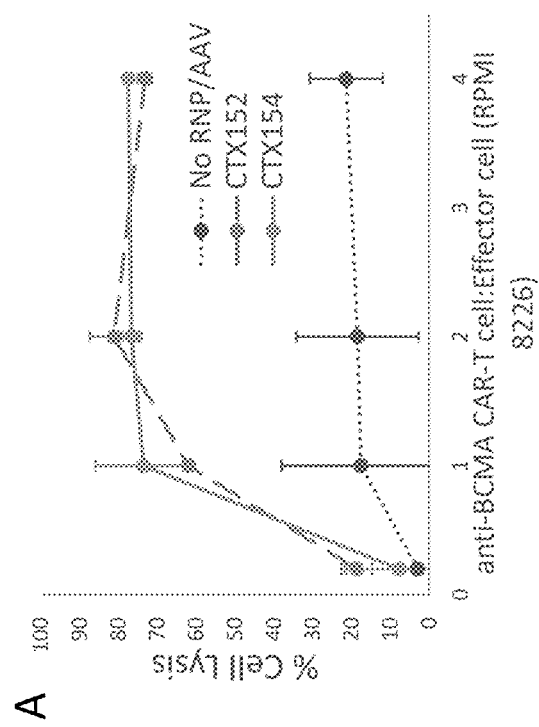
FIG. 33B is a graph showing high levels of IFNγ secretion from anti-BCMA CAR-T cells and minimal secretion from unmodified T-Cells (NO RNP/AAV). Both plots are from the same cytotoxicity experiment. Interferon gamma was measured according to the method described in Example 18.
Figure 47A:
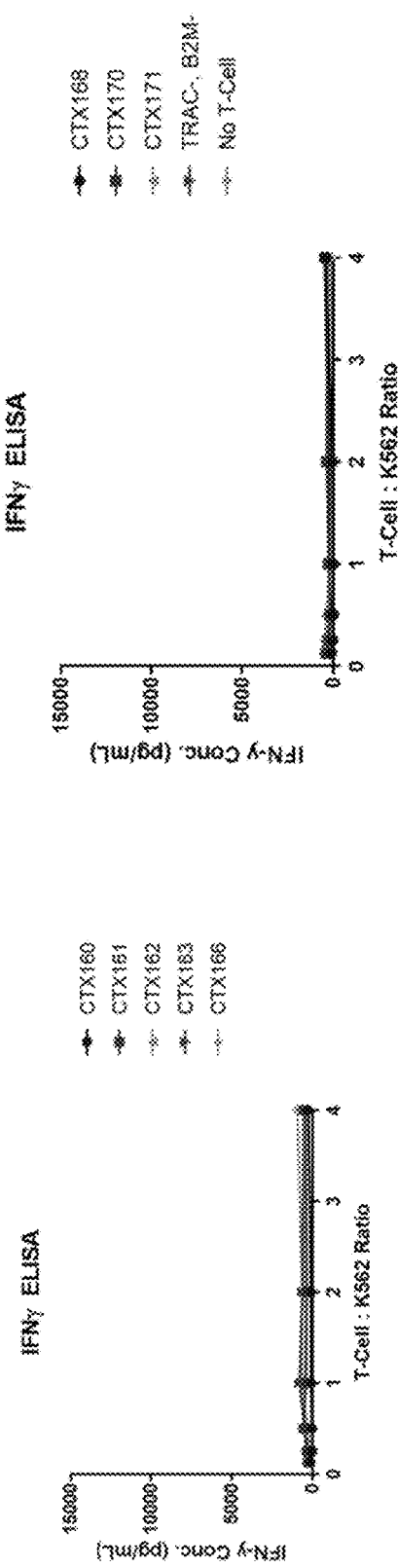
FIGS. 47A-47B are graphs of data demonstrating that other anti-BCMA CAR T cells secret interferon gamma specifically in the presence of cells expressing BCMA.
Figure 47B:
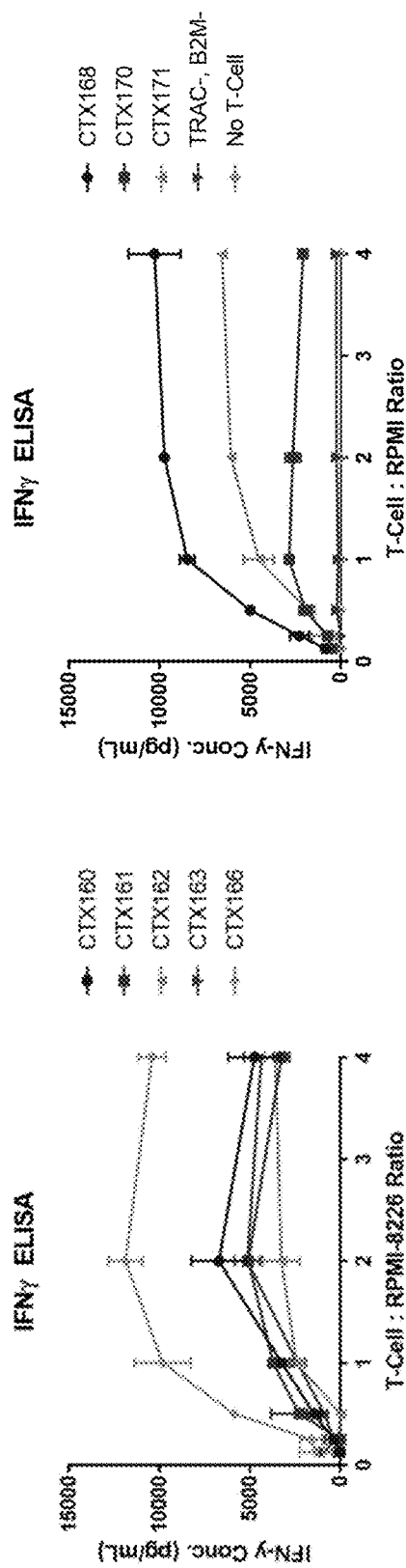

The specificity of genetically modified T cells expressing an anti-BCMA CAR integrated into the TRAC gene, was evaluated in an in vitro ELISA assay. IFNγ from supernatants of cell co-cultures was measured. RPMI8226 cells were cultured with genetically engineered T cells expressing the anti-BCMA CAR, or controls. FIG. 33B demonstrates that TRAC$^-$/B2M$^-$/anti-BCMA CAR+ T cells (cells expressing CTX152 or CTX154) secrete higher levels of IFNγ when cultured with RPMI8226 (ATCC Cat # ATCC-155) cells as compared to T cells that do not express the anti-BCMA CAR (no RNP/AAV) (at a 0.2:1, 1:1, 2:1, and 4:1 CAR-T cell to target ratio). Similarly, FIG. 46B (right graph) and FIG. 47B demonstrate that TRAC$^-$/B2M$^-$/anti-BCMA CAR+ T cells secrete higher levels of IFNγ when cultured with RPMI8226 (ATCC Cat # ATCC-155) cells as compared to the controls. FIG. 46A (right graph) shows that TRAC$^-$/B2M$^-$/anti-BCMA CAR+ T cells also secrete higher levels of IFNγ when cultured with U-266 cells. By contrast, FIG. 46C (right graph) and FIG. 47A show that TRAC$^-$/B2M$^-$/anti-BCMA CAR+ T cells do not secrete IFNγ when cultured with K562 cells (cells that do not express BCMA). Thus, not only do the anti-BCMA CAR T cells of the present disclosure produce IFNγ, they do so specifically in the presence of BCMA-expressing cells.

Example 22—Assessment of HDR Frequencies in CD19 CAR-T Cells Produced by CRISPR-Cas9

A droplet digital PCR (ddPCR) assay was designed to measure the efficiency of integration of the CAR construct (CTX-138) into the TRAC locus. The primers and probes used in the ddPCR assay are shown in Table 25. SEQ ID NO: 1554-1556 were used to detect integration of the CAR construct, and SEQ ID NOs: 1557-1559 were used to amplify a control reference genomic region.

Forty (40) ng of genomic DNA was used in ddPCR reactions, droplets generated and then run in a thermocycler under the conditions shown in Table 26 and Table 27.

Figure 34:
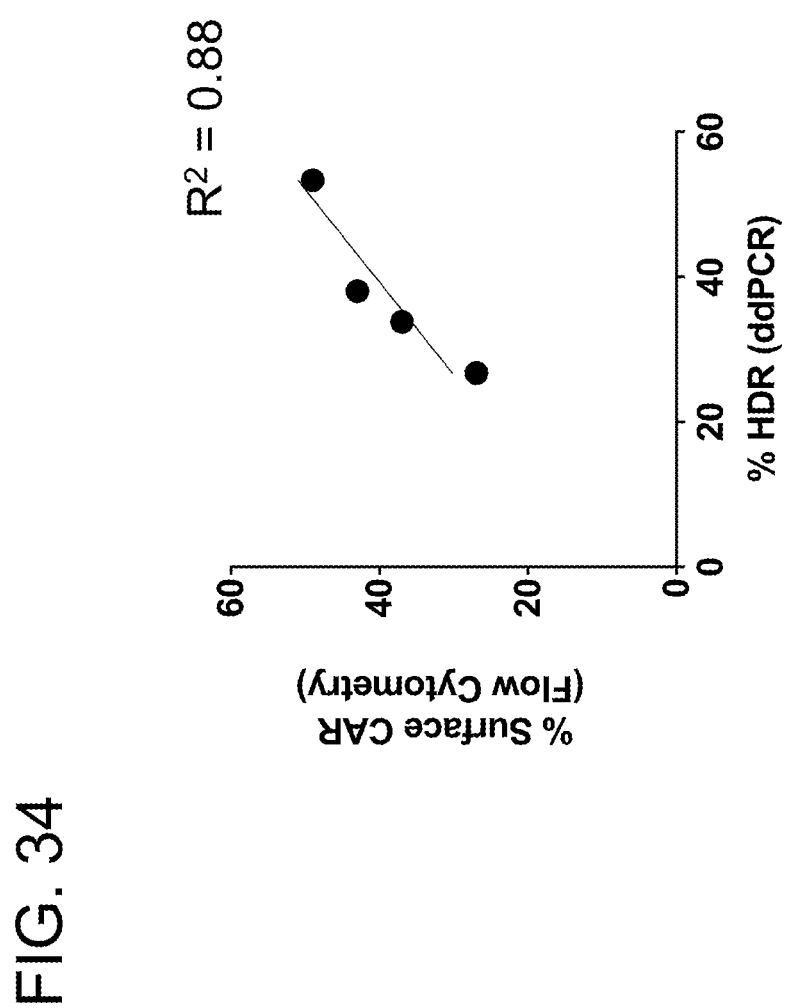
FIG. 34 is a graph showing a strong correlation between surface CD19 CAR expression and HDR frequency ($R^2$=0.88). This indicates site specific integration and high expression levels of CD19 CAR construct into the TRAC locus of T cells using CRISPR gene editing.

The percentage of cells that stained CD19 CAR+ by flow cytometry was plotted against the percentage of cells that were positive for an integrated CAR construct from 4 healthy donor TRAC−B2M−CAR-T cells (FIG. 34). The ddPCR results show a strong correlation between CD19 CAR expression and HDR frequency ($R^2$=0.88), indicating that we achieved site-specific integration and high expression levels of the CD19 CAR construct into the TRAC locus of T cells using CRISPR gene editing.

TABLE 25

Primers and Probes used in ddPCR assay

| Primers/Probes | Sequence | Locus | SEQ ID NO: |
|---|---|---|---|
| EH_TRAC_dPCR_F5 | AGAAGGATAAGATGGCGGAGG | TRAC | 1554 |
| EH_TRAC_dPCR_R5 | GCTTTCTGGCGTCCTTAGAA | TRAC | 1555 |
| EH_TRAC_Probe_3end_2 | TCTACCCTCTCATGGCCTAGAAGG | TRAC | 1556 |
| EH_control_1kb_F1 | TGGAGTGATTAGGAACATGAGCT | Control | 1557 |
| EH_control_1kb_R1 | AAGCTCAAGCACTTCTAGTTAGAAAC | Control | 1558 |
| EH_control_1kb_probe_1 | ATTCCACCCCACCTTCACTAAG | Control | 1559 |

TABLE 26

PCR mixture

| | 1X |
|---|---|
| 2X Droplet PCR Supermix | 12.5 |
| Forward Primer (18 uM) | 1.25 |
| Reverse Primer (18 uM) | 1.25 |
| Probe (5 uM) | 1.25 |
| Forward Primer (18 uM) | 1.25 |
| Reverse Primer (18uM) | 1.25 |
| Probe (5 uM) | 1.25 |
| H20 | |
| Mix volume | 20 |

TABLE 27

PCR conditions

| # Cycles | Temp | Duration of Cycle |
|---|---|---|
| 1 | 95 C. | 10 min |
| 40 | 90 C. | 30 sec |
| | 59 C. | 1 min |
| | 72 C. | 3 min |
| 1 | 98 C. | 10 min |
| 1 | 4 C. | forever |

Example 23—Evaluation of Effector Function of TRAC−/B2M−/anti-CD19 CAR+ T Cells on a B-ALL Cell Line In this example the effector functions of TRAC−/B2M−/anti-CD19 CAR+ T cells when co-cultured with the Nalm6 human B-ALL cell line were assessed.

GranzymeB Assay

To further assess the effector functions of TRAC−/B2M−/anti-CD19 CAR+ T cells, intracellular GranzymeB levels in target cells were measured in a surrogate cell lysis assay. GranzymeB secretion was assessed as described in Example 18. TRAC−/B2M−/anti-CD19 CAR+ T cells or control cells were cocultured with the Nalm6 cell line. As shown in FIG. 35A, TRAC−/B2M−/anti-CD19 CAR+ T cells co-cultured with the Nalm6 human B-ALL cell line at a 4:1 ratio exhibit efficient GranzymeB insertion indicating that TRAC−/B2M−/anti-CD19 CAR+ T cells can induce lysis of the CD19 positive Nalm6 B-ALL cell line.

Interferon Gamma Stimulation by Genetically Engineered T Cells Expressing a CD19 CAR The ability of the engineered cells to produce interferon gamma (IFNγ) in a target cell was analyzed using an ELISA assay, as herein and in Example 10.

IFNγ from supernatants of cell co-cultures was measured. TRAC−/B2M−/anti-CD19 CAR+ T cells secrete high levels of IFNγ when cultured with CD19 positive Nalm6 cells, as shown in FIG. 35B.

Cell Kill Assay for Suspension Cell Lines

To assess the ability of TRAC−/B2M−/anti-CD19 CAR+ T cells to kill suspension cell lines a flow cytometry based cell killing assay was designed. Cells were co-cultured with the Nalm6 human B-cell acute lymphoblastic leukemia (B-ALL) target cell line. The Nalm6 target cells were labeled with 5 µM efluor670 (eBiosciences), washed and incubated in co-cultures with T cells at varying ratios (from 0.1:1 to 8:1 T cells to target cells) at 50,000 target cells per well of a U-bottom 96-well plate overnight. The next day wells were washed, media was replaced with 200 µL of media containing a 1:500 dilution of 5 mg/mL DAPI (Molecular Probes) (to enumerate dead/dying cells). Finally, 25 µL of CountBright beads (Life Technologies) was added to each well. Cells were then processed by flow cytometry.

Cells per µL were then calculated from analyzed flow cytometry data:

Cells/µL=((number of live target cell events)/(number of bead events))×((Assigned bead count of lot (beads/50 µL))/(volume of sample))

Total cells were calculated by multiplying cells/µL×the total volume of cells.

The percent cell lysis was then calculated with the following equation:

% Cell lysis=(1−((Total Number of target Cells in Test Sample)/(Total Number of Target Cells in Control Sample))×100.

FIG. 35C shows that TRAC−/B2M−/anti-CD19 CAR+ T cells selectively killed Nalm6 cells at low T to target cell ratios. The results indicate that the CRISPR/Cas9 modified T cells described herein, induce potent cell lysis in CD19 expressing acute lymphoblastic leukemia cell line.

Example 24—Creation of PD1, B2M, TRAC Triple Knockout Anti-CD19 CAR-T Cells

This example describes the production by CRISPR/Cas9 and AAV6 of allogeneic human T cells that lack expression of the TCR, MHC I, and PD1 and express a chimeric antigen receptor targeting CD19+ cancers.

CRISPR/Cas9 and AAV6 were used as above (see for example, Examples 8-10 and 12) to create human T cells that lack expression of the TCR, B2M and PD1 with concomitant expression from the TRAC locus using a CAR construct targeting CD19 (CTX-138; SEQ ID NO: 675). In this example activated T cells were electroporated with 3 distinct RNP complexes containing sgRNAs targeting TRAC (e.g.: SEQ ID NO: 76), B2M (e.g.: SEQ ID NO: 417 and PD1 (CTGCAGCTTCTCCAACACAT (SEQ ID NO: 916)). The gRNAs used in this Example comprise the following spacer sequences: TRAC gRNA spacer (AGAGCAACAGUGCUGUGGCC (SEQ ID NO: 152)); B2M gRNA spacer (GCUACUCUCUCUUUCUGGCC (SEQ ID NO: 466)); and PD1 gRNA spacer (CUGCAGCUUCUCCAACACAU (SEQ ID NO: 1086)). About 1 week post electroporation cells were either left untreated or treated with PMA/ionomycin overnight. The next day cells were processed for flow cytometry.

FIG. 58A shows that only cells treated with PD1 sgRNA containing RNP do not upregulate PD1 surface levels in response to an overnight treatment of PMA/ionomycyin.

Figure 37A:
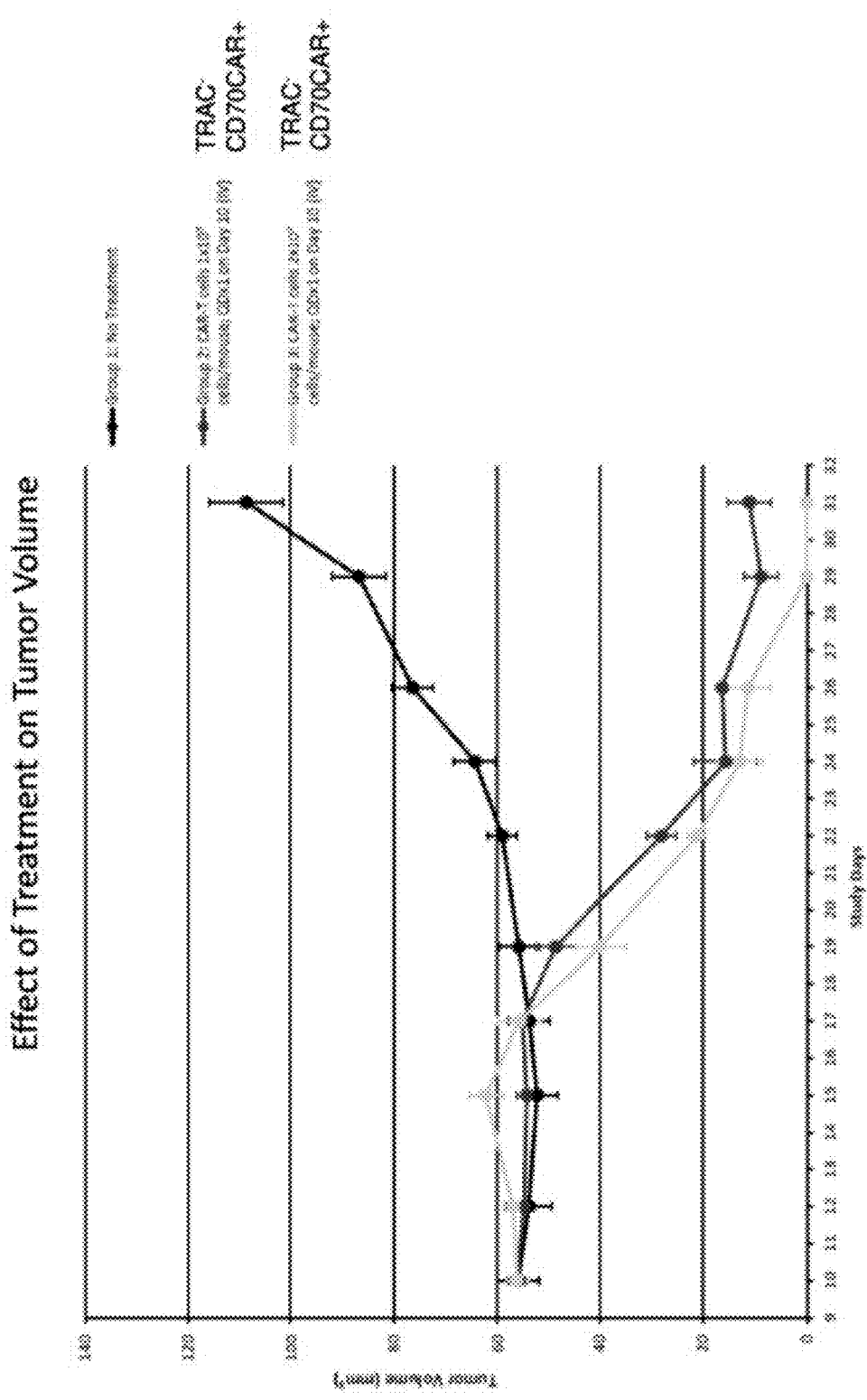
FIG. 37A is a graph depicting a decrease in tumor volume ($mm^3$) at day 31 following treatment of NOG mice that were injected subcutaneously with A498 renal cell carcinoma cell lines with TRAC−/anti-CD70 CAR+ T cells. All Groups of NOG mice were injected with $5×10^6$ cells/mouse. Group 1 received no T cell treatment. Mice in Group 2 were treated intravenously with $1×10^7$ cell/mouse of TRAC−/anti-CD70 CAR+ T cells on day 10. Mice in Group 3 were treated intravenously with $2×10^7$ cell/mouse of TRAC−/anti-CD70 CAR+ T cells on day 10.
Figure 37B:
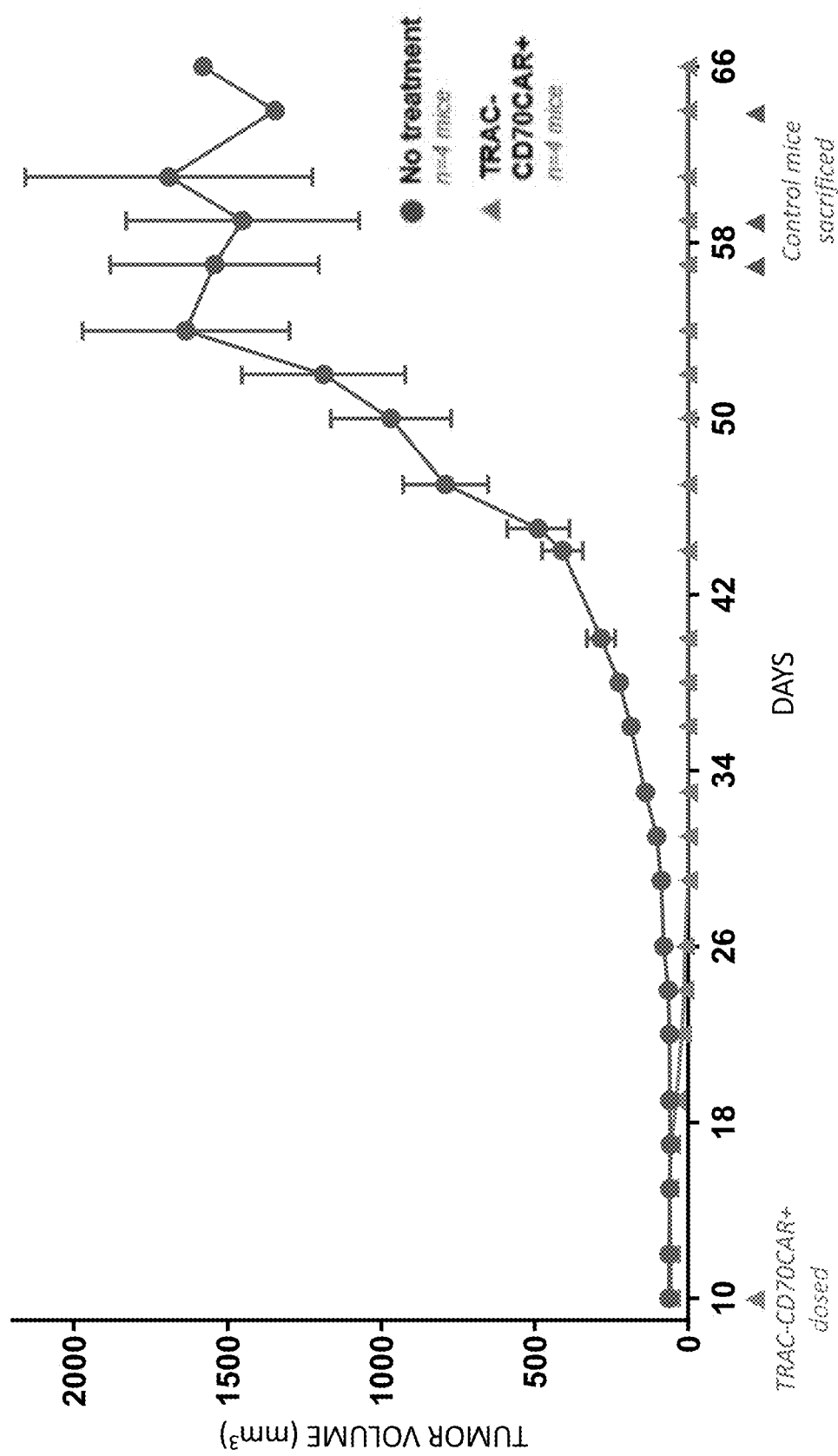
FIG. 37B is a graph depicting a decrease in tumor volume ($mm^3$) following treatment of NOG mice that were injected subcutaneously with A498 renal cell carcinoma cell lines with TRAC−/anti-CD70 CAR+ T cells. Both Groups of NOG mice were injected with $5×10^6$ cells/mouse. The control group received no T cell treatment, and the test group of mice were treated intravenously with $2×10^7$ cell/mouse of TRAC−/anti-CD70 CAR+ T cells on day 10.

Example 25—Efficacy of CD70 CAR+ T Cells: The Subcutaneous Renal Cell Carcinoma Tumor Xenograft Model in NOG Mice NOG mice were injected subcutaneously with $5\times10^6$ A498 renal cell carcinoma cells. At day 10 post inoculation mice were either left untreated or injected intravenously (I.V.) with a therapeutic dose of $1\times10^7$ or $2\times10^7$ anti-CD70 CAR-T cells. Tumor volumes were measured every 2 days for the duration of the study (31 days). Injection of anti-CD70 CART cells lead to decreased tumor volumes at both doses (FIG. 37). These data show that anti-CD70 CART cells can regress CD70+ kidney cancer tumors in vivo.

Transgene insertion in primary human T cells via homology directed repair (HDR) and concurrent gene knockout by Cas9:sgRNA RNA was performed as described above in Example 16 to produce cells lacking TCR surface expression and to concurrently express an anti-CD70 CAR construct (TRAC⁻/anti-CD70CAR+ cells). Primary human T cells were first electroporated with Cas9 or Cas9:sgRNA RNP complexes targeting TRAC (AGAGCAACAGTGCT-GTGGCC (SEQ ID NO: 76); TRAC gRNA spacer (AGAG-CAACAGUGCUGUGGCC (SEQ ID NO: 152)). The DNA double stranded break at the TRAC locus was repaired by homology directed repair with an AAV6-delivered DNA template (CTX-145; SEQ ID NO: 1359) containing right and left homology arms to the TRAC locus flanking a chimeric antigen receptor cassette (−/+ regulatory elements for gene expression). The resulting modified T cells are TRAC⁻/anti-CD70CAR+. The ability of the modified TRACI anti-CD70CAR+ T cells to ameliorate disease caused by a CD70+ renal carcinoma cell line was evaluated in NOG mice using methods employed by Translational Drug Development, LLC (Scottsdale, Ariz.). In brief, twelve (12), 5-8 week old female, CIEA NOG (NOD.Cg-Prkdc$^{scid}$I12rg$^{tm1Sug}$/JicTac) mice were individually housed in ventilated microisolator cages, maintained under pathogen-free conditions, 5-7 days prior to the start of the study. On Day 1 mice received a subcutaneous inoculation of $5\times10^6$ A498 renal carcinoma cells/mouse. The mice were further divided into 3 treatment groups as shown in Table 26. On Day 10 (9 days post inoculation with the A498 cells), treatment group 2 and group 3 received a single 200 µl intravenous dose of TRAC⁻/anti-CD70CAR+cells according to Table 26.

TABLE 28

Treatment groups

| Group | A498 cells | T cell treatment (i.v.) | N |
|---|---|---|---|
| 1 | $5 \times 10^6$ cells/mouse | None | 8 |
| 2 | $5 \times 10^6$ cells/mouse | $1 \times 10^7$ cells/mouse | 3 |
| 3 | $5 \times 10^6$ cells/mouse | $2 \times 10^7$ cells/mouse | 3 |

Tumor volumes were measured every 2 days. By Day 18 treatment with the anti-CD70 CART cells at both doses began to show a decrease in tumor volume (FIG. 37). Tumor volume continues to decrease for the duration of the study. These data demonstrate that anti-CD70 CART cells can regress CD70+ kidney cancer tumors in vivo.

Example 26—Anti-BCMA CAR Expression and Cytotoxicity

Allogeneic anti-BCMA CAR T cells were generated as described above. Anti-BCMA CAR expression was measured by determining the percent of cells that bound biotinylated BCMA subsequently detected by FACS using streptavidin-APC (FIG. 47).

Figure 48:
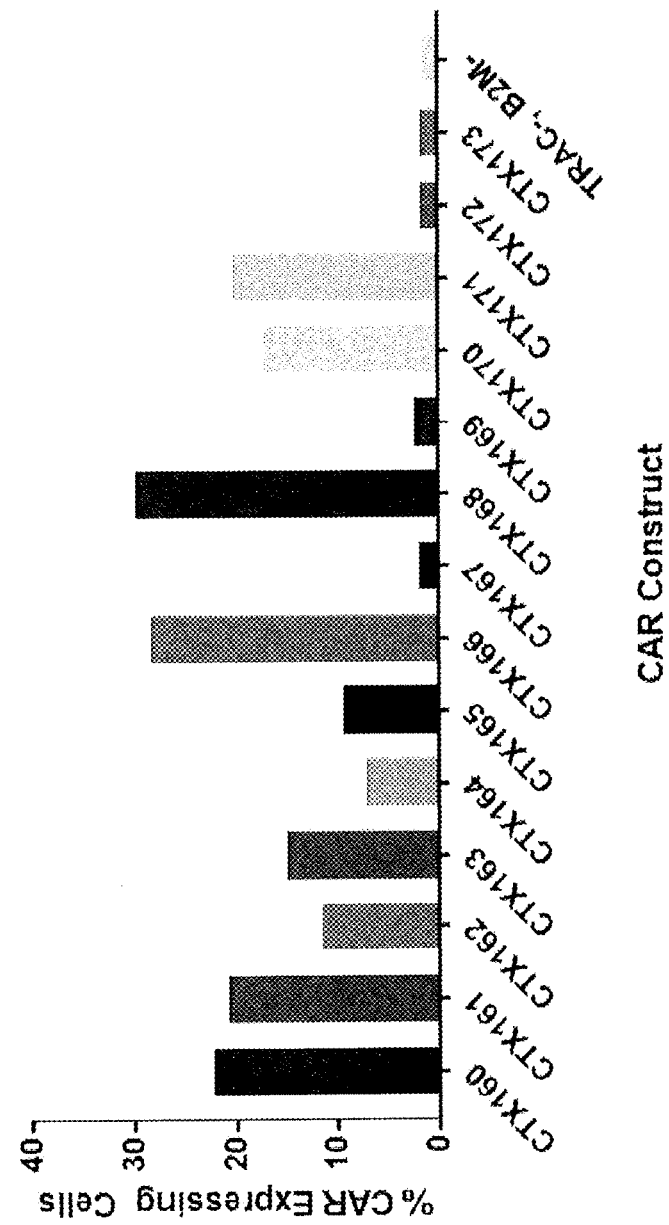
FIG. 48 is a graph showing anti-BCMA CAR expression. Allogeneic CAR T cells were generated as previously described. Anti-BCMA CAR expression was measured by determining the percent of cells that bound biotinylated recombinant human BCMA subsequently detected by FACS using streptavidin-APC.
Figure 49A:
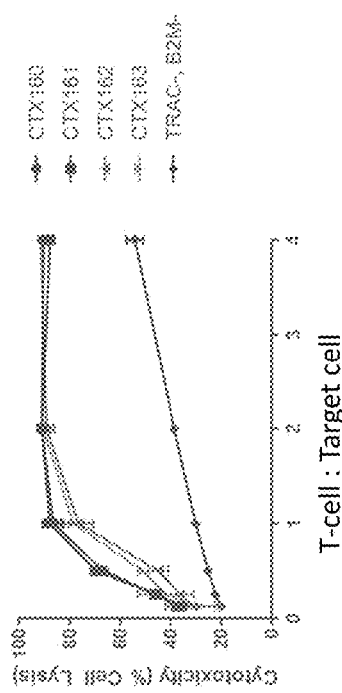
FIGS. 49A-49C are graphs of data demonstrating that anti-BCMA CAR T cells expressing the CAR are potently cytotoxic towards RPMI-8226 cells. CAR constructs were evaluated for their ability to kill RPMI-8226 cells. All CAR T cells were potently cytotoxic towards effector cells while allogeneic T cells lacking a CAR showed little cytotoxicity.
Figure 49B:
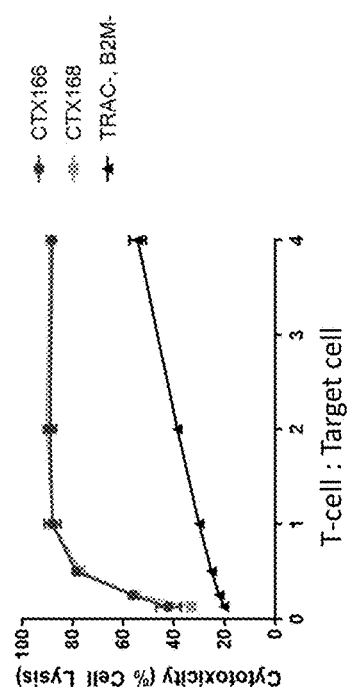
Figure 49C:
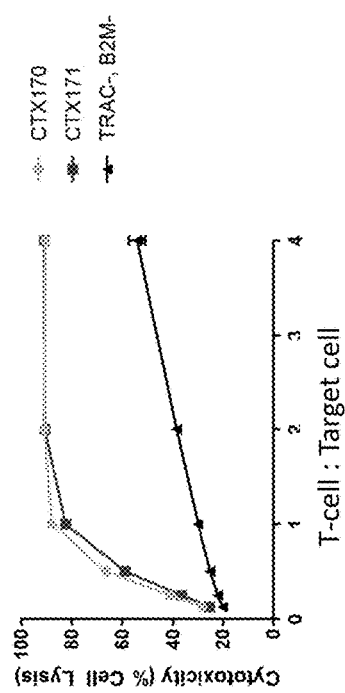
Figure 51:
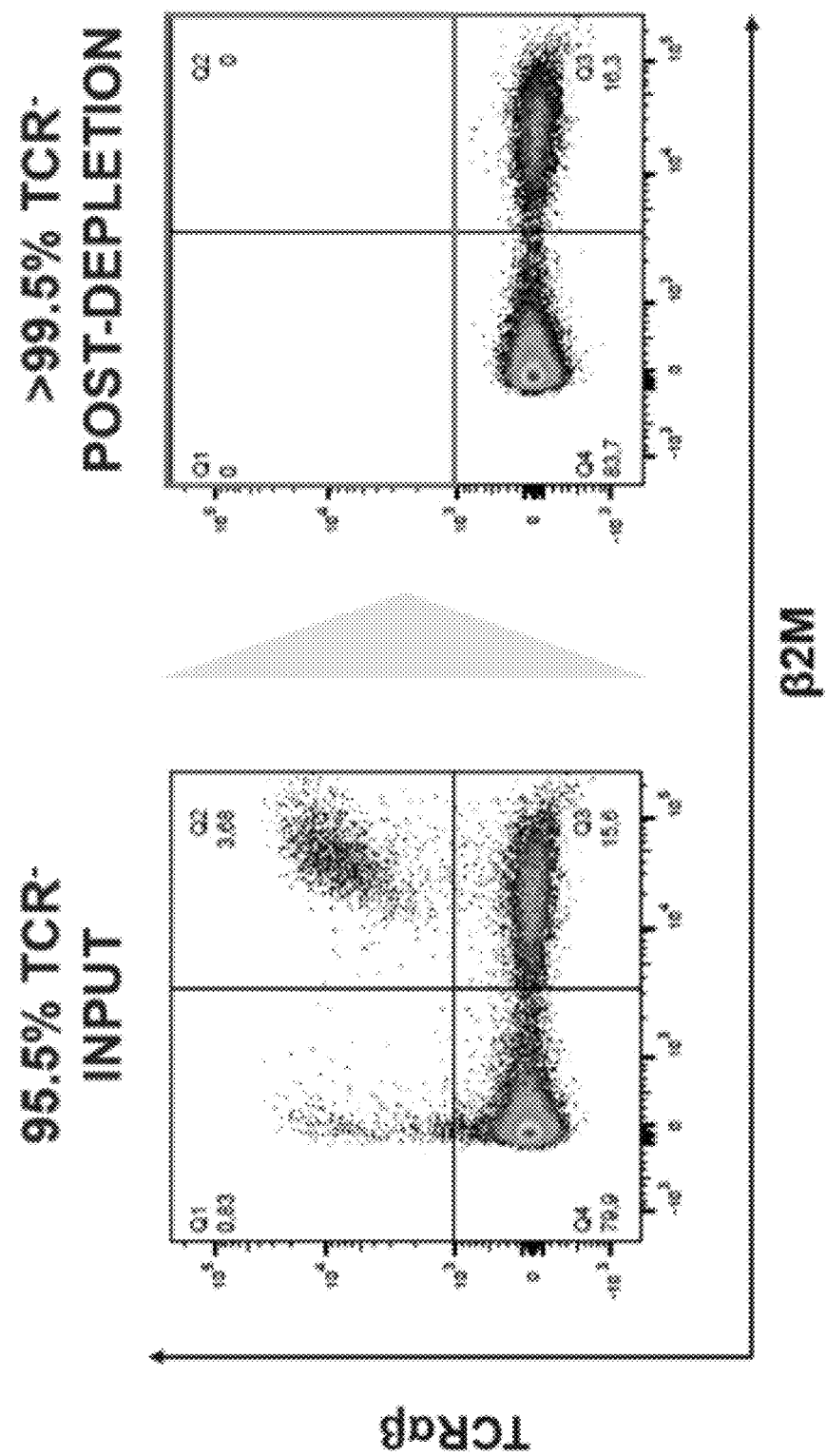
FIG. 51 shows flow cytometry graphs demonstrating that 95.5% of the gene edited cells are TCR negative, without further enrichment for a TCR negative cell population. Following enrichment/purification, greater than 99.5% of the gene edited cells are TCR negative.

Anti-BCMA CAR constructs were then evaluated for their ability to kill RPMI-8226 cells. All Anti-BCMA CAR T cells with ≥10% expression were potently cytotoxic towards effector cells, while allogeneic T cells lacking a CAR showed little cytotoxicity (FIG. 48).

Example 27—Cell Health Maintenance Post Gene Editing

Allogenic anti-CD19 CAR T cells were generated as described above. At 21 days post gene editing, the following protocol was used to stain cells for expression of the indicated marker:

Stain cells with the following antibody for 30 min at 4° C.
Anti-mouse Fab2 biotin 115-065-006 (Jackson ImmunoRes) 1:5
Wash cells 1× with FACS buffer.
Add 1 µg of normal mouse IGG (Peprotech 500-M00) to 100 µL of cells for 10 min at RT.
Wash cells 1× with FACS buffer and resuspend in 100 µL of FACS buffer.
Stain cells with the following cocktail for 15 min at RT.
The antibodies used in this Example are as follows:

TABLE 29

| Antibody | Clone | Fluor | Catalogue # | Dilution | For 1 |
|---|---|---|---|---|---|
| CD4 | RPA-T4 | BV510 | 300545 (Biolegend) | 1:100 | 1 uL |
| CD8 | SK1 | BV605 | 344741 (Biolegend) | 1:100 | 1 uL |
| CD45RA | HI100 | APC-CY7 | 304128 (Biolegend) | 1:100 | 1 uL |
| CCR7 | G043H7 | Pacific Blue | 353210 (Biolegend) | 1:100 | 1 uL |
| PD1 | EH12.2H7 | PE | 329906 (Biolegend) | 1:100 | 1 uL |
| LAG3 | 11C3C65 | PE-Cy7 | 369310 (Biolegend) | 1:100 | 1 uL |
| CD57 | HCD57 | FITC | 322306 (Biolegend) | 1:100 | 1 uL |
| Streptavidin | | APC | 17-4317-82 (eBioscience) | 1:100 | 1 uL |

This data shows that health of TRAC−/B2M−/anti-CD19+CAR T cells is maintained at day 21 post gene editing (the cells behave as normal (unedited) cells).

Example 28—Comparison of TCR Genotype in Gene Edited Cells Pre- and Post-Enrichment TRAC−/B2M−/anti-CD19+CAR T cells (TC1) cells were produced and were depleted using TCRab antibodies and the Prodigy System (Miltenyi Biotech). Purities of >99.5% TCRab⁻ cells in the total population were achieved from starting inputs of 95.5% TCRab-cells.

Example 29—Allogeneic Anti-BCMA CAR T Cell Targeting

This example demonstrates the generation of an allogeneic anti-BCMA CAR-T cells using CRISPR/Cas9 genome editing. High efficiency editing was attained with over 60% of the cells harboring the three desired edits. The CAR-T cells maintain a normal CD4/CD8 ratio, as well as characteristic cytokine dependency, suggesting neither abnormal tonic signaling from CAR insertion nor transformation due to the editing process have occurred. The CAR-T cells selectively killed BCMA cells and secreted T cell activation cytokines following encounter with BCMA-expressing cells. The CAR-T cells eradicated MM cells in a subcutaneous RPMI-8226 tumor xenograft model, confirming potent activity in vivo.

High Efficiency Genome Editing by CRISPR/Cas9

Figure 52A:
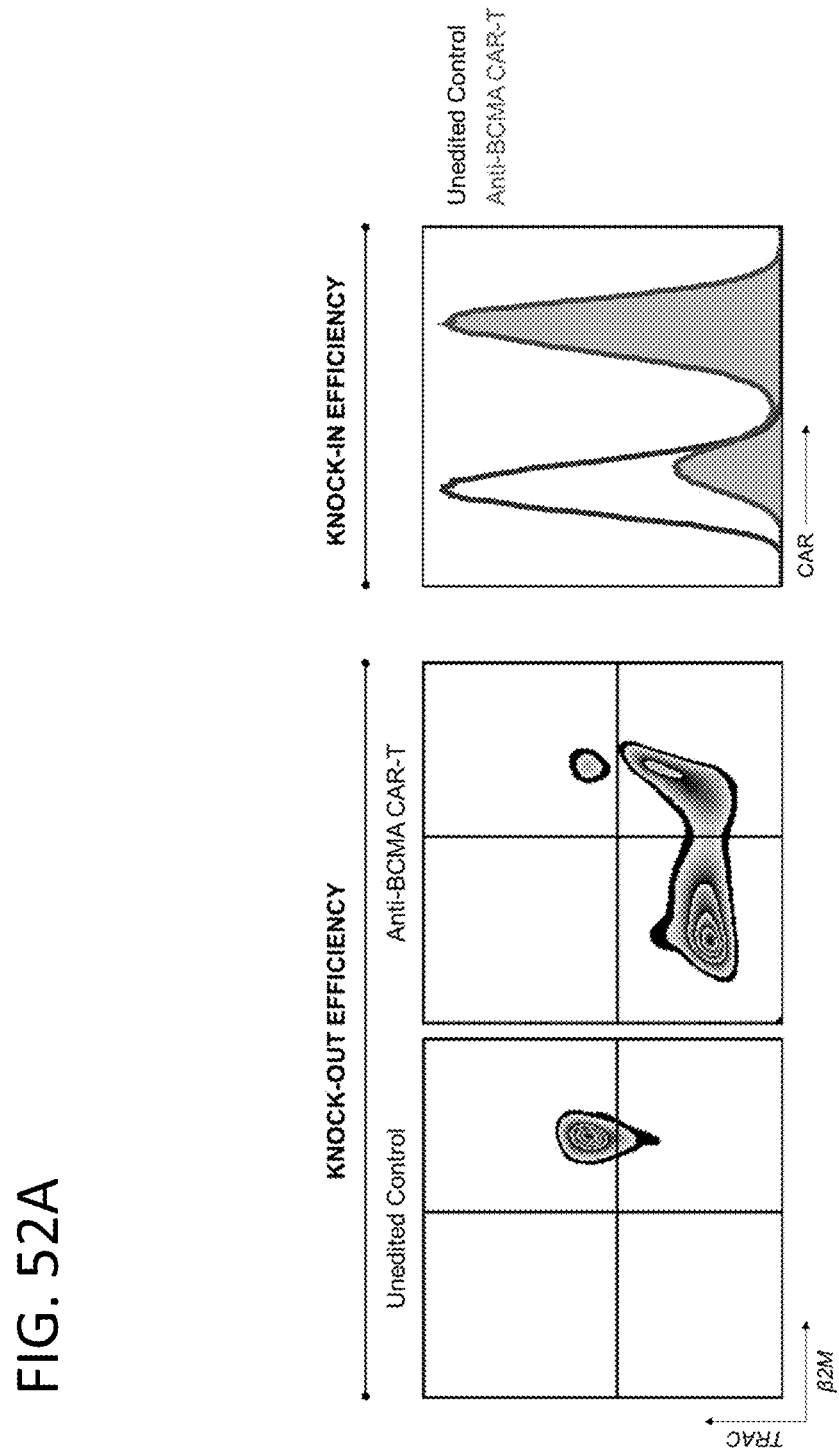
FIG. 52A shows a representative FACS plot of β2M and TRAC expression one week following gene editing (left) and a representative FACS plot of CAR expression following knock-in to the TRAC locus (right).
Figure 52B:
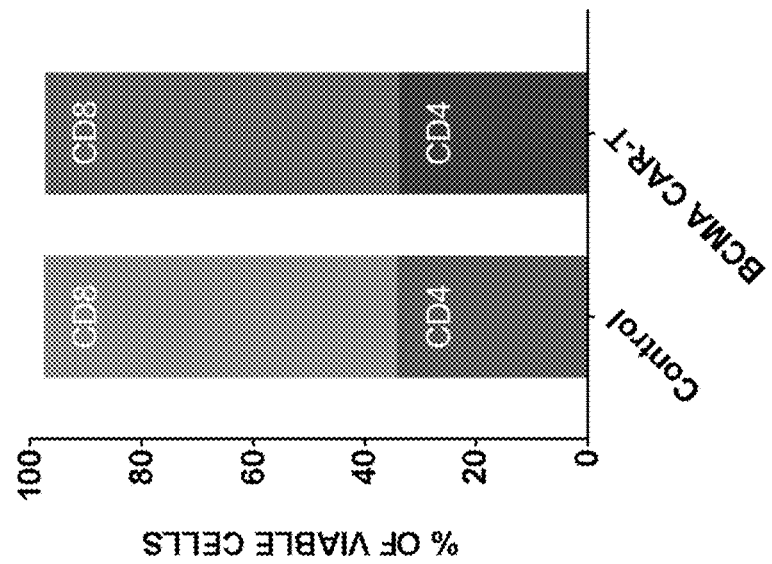
FIG. 52B is a graph showing decreased surface expression of both TCR and MHC-I observed following gene editing. Combined with a high CAR expression, this leads to more than 60% cells with all desired modifications (TCR−/β2M−/CAR+).
Figure 52C:
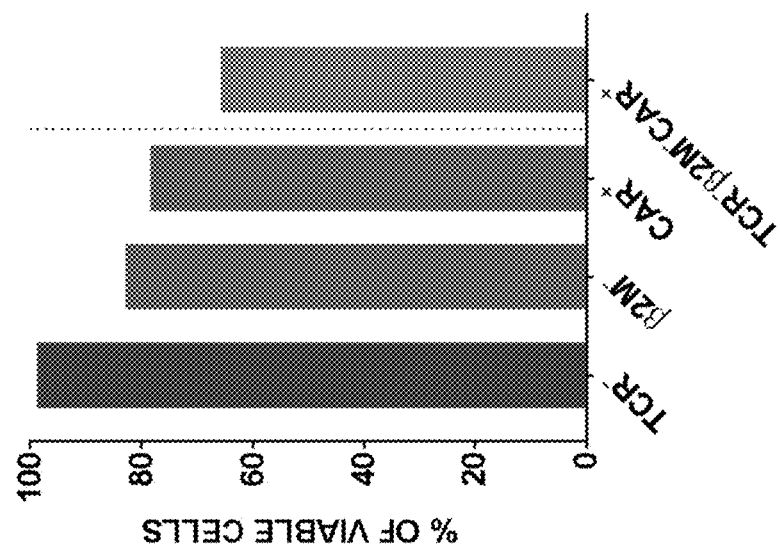
FIG. 52C is a graph showing that production of allogeneic anti-BCMA CAR-T cells preserves CD4 and CD8 proportions.

TRAC$^-$/B2M$^-$/anti-BCMA CAR+ cells were generated using the methods described in Example 19. FIG. 52A shows a FACS plot of β2M and TRAC expression one week following gene editing (left) and a representative FACS plot of CAR expression following knock-in to the TRAC locus (right). FIG. 52B is a graph showing decreased surface expression of both TCR and MHC-I following gene editing. Combined with a high CAR expression, this leads to more than 60% cells with all desired modifications (TCR–/β2M–/anti-BCMA CAR+).

T Cell CD4+/CD8+ Ratio Following Editing

At two weeks post gene editing, the following protocol was used to stain TCR–/β2M–/anti-BCMA CAR+ cells for expression of the indicated marker:

Stain cells with the following antibody for 30 min at 4° C.

Recombinant biotinylated human BCMA (Acro Biosystems Cat: # BC7-H82F0 at a concentration of 100 nM Wash cells 1× with FACS buffer and resuspend in 100 μL of FACS buffer.

Stain cells with the following cocktail for 15 min at RT.

The antibodies used in this Example were CD4 and CD8 (See Table 27). This data showed that the edited T cells had the same CD4+/CD8+ ratio as unedited T cells.(data not shown).

Figure 53:
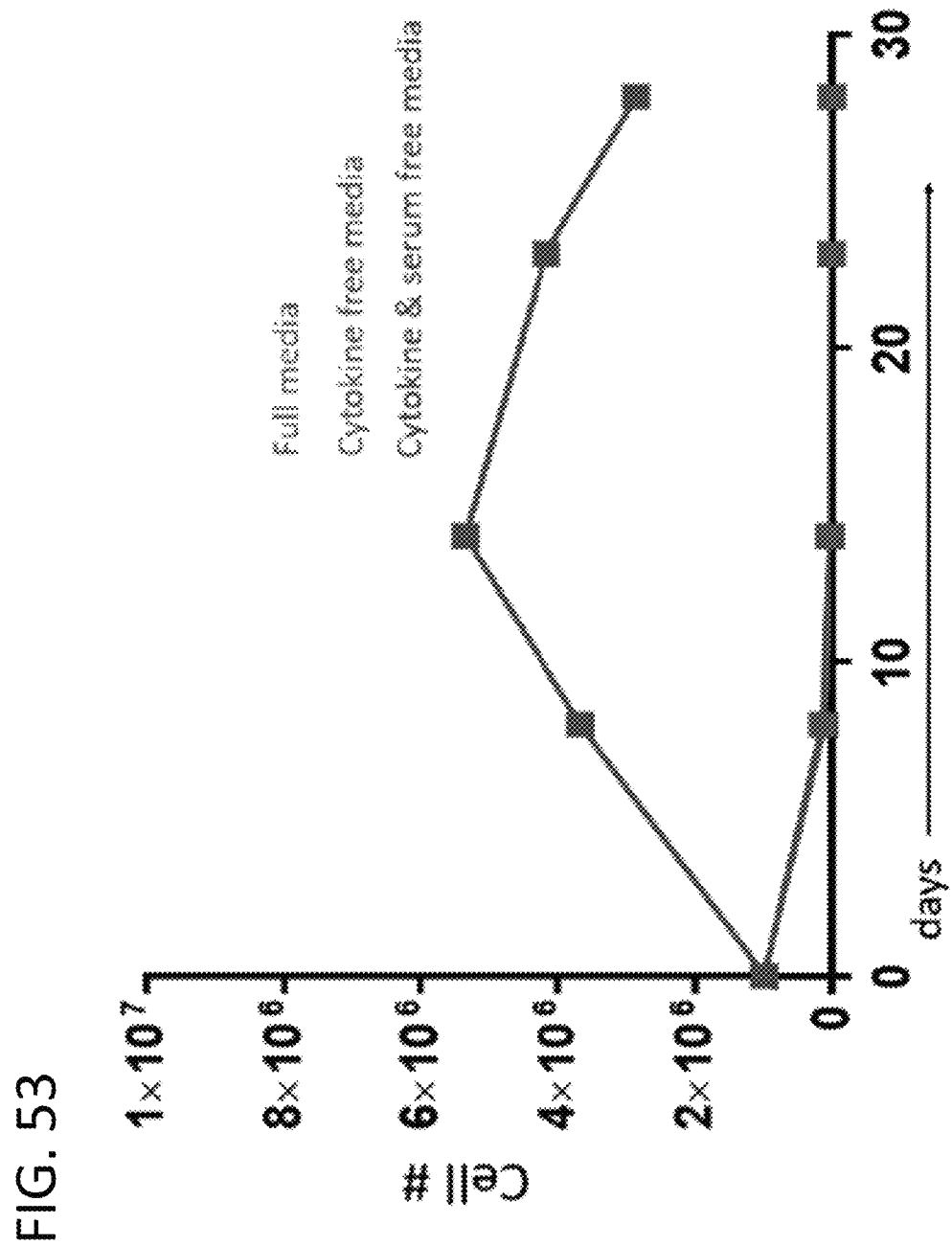
FIG. 53 is a graph showing that allogenic BCMA–CAR-T cells maintain dependency on cytokines for ex vivo expansion.

Two weeks following editing and andti-BCMA CAR knock-in, serum and/or cytokines were removed from the growth media. As expected, in the absence of cytokines no further proliferation of T-cells was observed (FIG. 53). Additionally, T-cells showed reduced proliferation following prolonged in vitro culture.

Allogeneic Anti-BCMA CAR T Cells Show Potent and Specific Activity In Vitro

To assess the ability of TRAC$^-$/B2M$^-$/anti-BCMA CAR+ T cells to selectively kill a BCMA expressing multiple myeloma cell line (MM.1S), a flow cytometry based cell killing assay was designed, similar to the assay described in Example 21. The TRAC$^-$/B2M$^-$/anti-BCMA CAR+ T cells (see Example 19 for Table of CARs used) were co-cultured with cells of the BCMA-expressing MM.1S multiple myeloma cell line or cells of the K562 cell line, which do not express BCMA (collectively referred to as the "target cells").

Target cells per μL were then calculated from analyzed flow cytometry data:

Cells/μL=((number of live target cell events)/(number of bead events))×((Assigned bead count of lot (beads/50 μL))/(volume of sample))

Total target cells were calculated by multiplying cells/μL×the total volume of cells.

The percent cell lysis was then calculated with the following equation:

% Cell lysis=(1−((Total Number of Target Cells in Test Sample)/(Total Number of Target Cells in Control Sample))×100.

FIG. 54A shows that TRAC–/B2M–/anti-BCMA CAR+ T cells selectively killed MM.1S cells but showed no specific toxicity toward K562 cells (which lack BCMA expression). The results indicate that the CRISPR/Cas9 modified T cells described herein, induce potent cell lysis in a BCMA-expressing multiple myeloma cell line.

The ability of the engineered TRAC–/B2M–/anti-BCMA CAR+ T cells to produce interferon gamma (IFNγ) and IL-2 in response to target cells was analyzed using an ELISA assay, as described above and in Examples, 10, 18, and 21.

The specificity of genetically modified T cells expressing an anti-BCMA CAR integrated into the TRAC gene, was evaluated in an in vitro ELISA assay. IFNγ and IL-2 from supernatants of cell co-cultures was measured. MM.1S cells were cultured with genetically engineered T cells expressing the anti-BCMA CAR, or controls. FIG. 54B demonstrates that TRAC$^-$/B2M$^-$/anti-BCMA CAR+ T cells (cells expressing CTX166) secrete higher levels of IFNγ and IL-2 when cultured with MM.1S cells as compared to T cells that do not express the anti-BCMA CAR (unedited T cells). By contrast, the TRAC$^-$/B2M$^-$/anti-BCMA CAR+ T cells do not secrete IFNγ or IL-2 when cultured with K562 cells (cells that do not express BCMA).

Figures 54C, 54D:
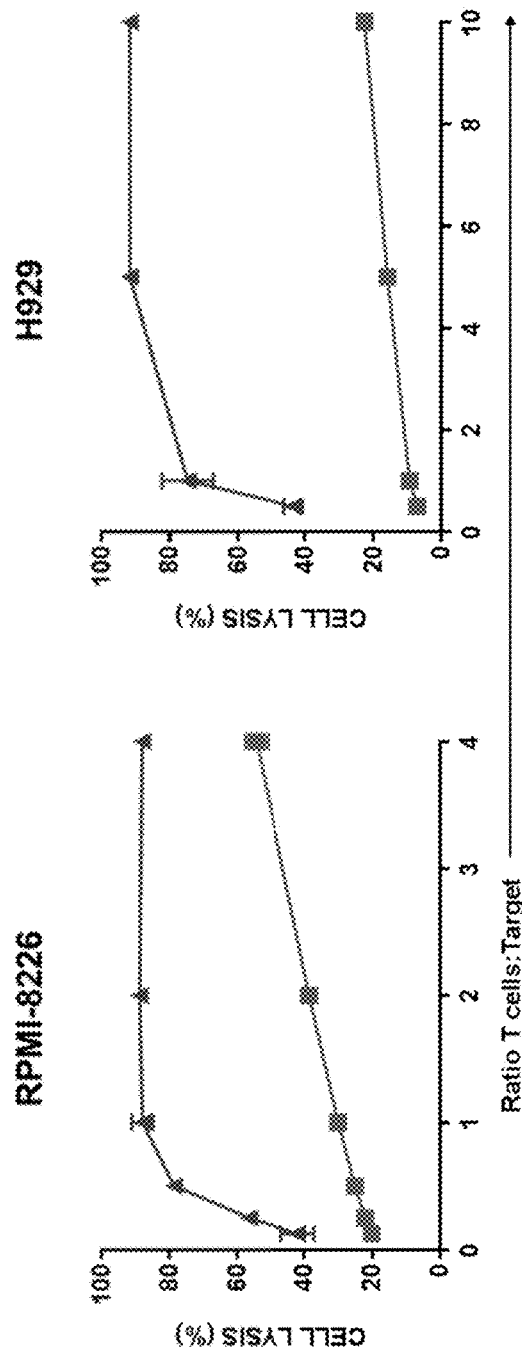
(FIG. 54C) RPMI-8226 (24-hour assay) and (FIG. 54 D) H929 (4-hour assay).

The cell kill assay was repeated with the addition of the multiple myeloma cell line H929, which expresses higher levels of BCMA compared to MM.1S (FIG. 54C). FIG. 54D shows that accelerated kill of the H929 cells was observed compared to the MM1s cells (D). The cell kill efficiency is shown using a ratio of 1:1 effector to T cell.

Thus, not only do the anti-BCMA CAR T cells of the present disclosure produce IFNγ and IL-2, they do so specifically in the presence of BCMA-expressing cells.

Allogeneic Anti-BCMA CAR T Cells Show Potent Activity In Vivo

In this example, the efficacy of CAR-T cells against the subcutaneous RPMI-8226 tumor xenograft model in NOG mice was evaluated. In brief, 12, 5-8 week old female, CIEA NOG (NOD.Cg-Prkdc$^{scid}$I12rg$^{tm1Sug}$/JicTac) mice were individually housed in ventilated microisolator cages, maintained under pathogen-free conditions, 5-7 days prior to the start of the study. On Day 1 mice received a subcutaneous inoculation of 10×10$^6$ RPMI-8226 cells/mouse. The mice were further divided into two treatment group. Ten (10) days post inoculation with RPMI-8226 cells, the first treatment group (N=5) received a single 200 μl intravenous dose of 10×10$^6$ edited TRAC$^-$/B2M$^-$/anti-BCMA CAR+ T cells, and the second treatment group (N=5) received a single 200 μl intravenous dose of 20×10$^6$ edited TRAC$^-$/B2M$^-$/anti-BCMA CAR+ T cells.

Figure 55:
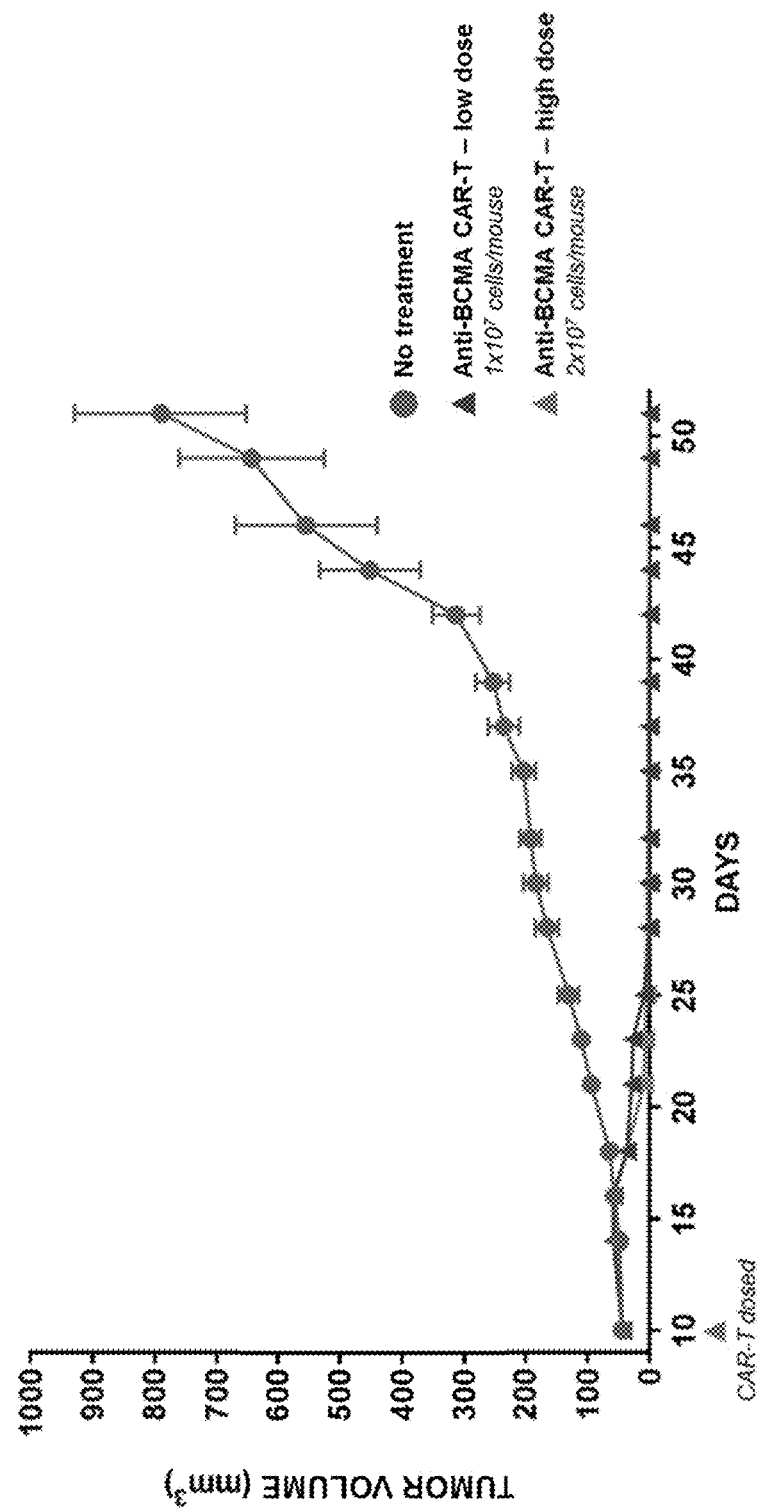
FIG. 55 is a graph showing that allogeneic anti-BCMA CAR-T cells eradicate tumors in a subcutaneous RPMI-8226 tumor xenograft model. 1×107 RPMI-8226 cells were injected subcutaneously into NOG mice, followed by CAR-T cells intravenously 10 days after inoculation. No clinical signs of GvHD were observed in the mice at any timepoint. N=5 for each group.

Tumor volume and body weight was measured and individual mice were euthanized when tumor volume was ≥500 mm$^3$. By Day 18, the data show a statistically significant decrease in the tumor volume in response to TRAC$^-$/B2M$^-$/anti-BCMA CAR+ T cells as compared to untreated mice (FIG. 55).

PD1, B2M, TRAC Triple Knockout anti-BCMA CAR-T Cells

This example describes the production by CRISPR/Cas9 and AAV6 of allogeneic human T cells that lack expression of the TCR, MHC I, and PD1 and express a chimeric antigen receptor targeting BCMA+ cancers.

Figure 38A:
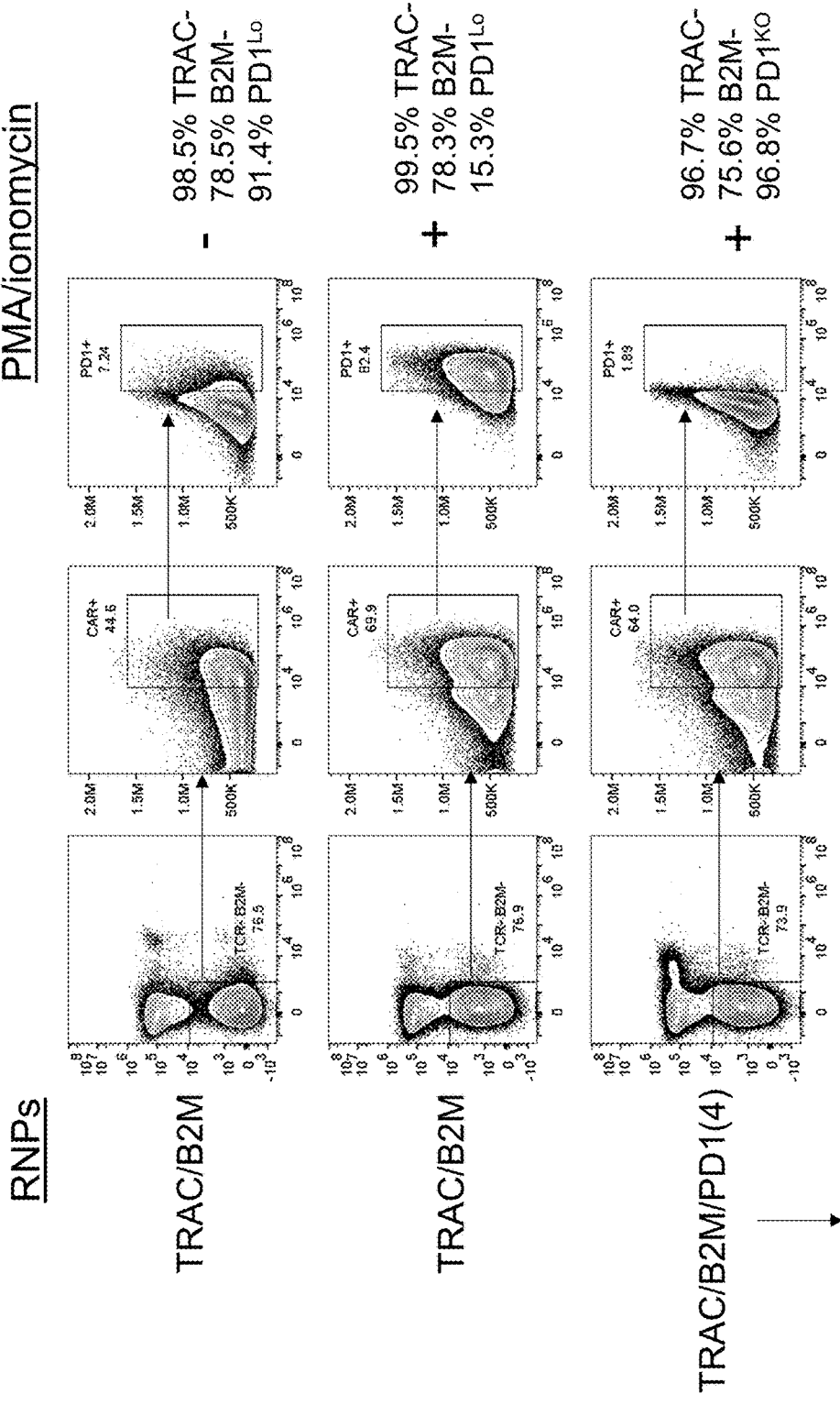
FIG. 38A is a series of flow cytometry plots demonstrating the production of anti CD19 CAR-T cells expressing the CAR and lacking surface expression of TCR and B2M, which either have low or absent surface expression of PD1 ($PD1^{LO}$ and $PD1^{KO}$, respectively). Preferred anti-CD19 CAR-T cells express the CAR and lack surface expression of TCR, B2M and PD1.
Figure 38B:
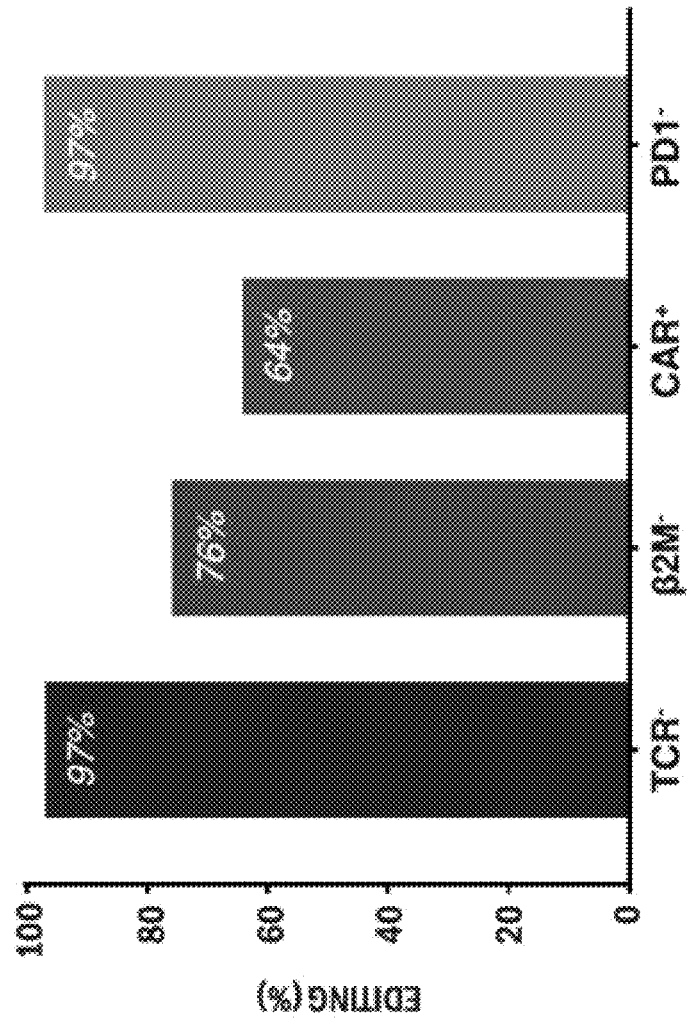
FIG. 38B is a bar graph depicting the editing efficiency for each gene edit as measured by flow cytometry. Measurements were taken from the cell population depicted in the bottom row of FIG. 38A.

CRISPR/Cas9 and AAV6 were used as above (see for example, Examples 8-10 and 12) to create human T cells that lack expression of the TCR, B2M and PD1 with concomitant expression from the TRAC locus using a CAR construct targeting BCMA (SEQ ID NO: 1434). In this example activated T cells were electroporated with 3 distinct RNP complexes containing sgRNAs targeting TRAC (e.g., TRAC gRNA spacer SEQ ID NO: 152), B2M (e.g., B2M gRNA spacer SEQ ID NO: 466) and PD1 (e.g., PD1 gRNA spacer SEQ ID NO: 1086). About 1 week post electroporation cells were either left untreated or treated with PMA/ionomycin overnight. The next day cells were processed for flow cytometry. FIG. 38 shows that only cells treated with PD1 sgRNA containing RNP do not upregulate PD1 surface levels in response to an overnight treatment of PMA/ionomycin.

Example 30—Allogeneic Anti-CD70 CAR T Cell Targeting

High Efficiency CRISPR/Cas9 Gene Editing to Produce Allogeneic Anti-CD70 CAR-T Cells This example demonstrates efficient transgene insertion and concurrent gene knockout by Cas9:sgRNA RNP (for double stranded break induction) and AAV6 delivered donor template containing a CD70 CAR construct (SEQ ID NO: 1424) in primary human T cells. The experiments described here are similar to those described in Example 16.

Primary human T cells were activated with CD3/CD28 magnetic beads (as described previously in Example 2). Three days later activation beads were removed. The next day cells were electroporated with RNP complexes including sgRNAs targeting either TRAC alone, or TRAC+B2M (two separately complexed RNPs). Seven days post manipulation, cells were analyzed by flow cytometry, as previously described herein and in Example 2.

Guides used in this example target:

```
                                          (SEQ ID NO: 76)
TRAC: AGAGCAACAGTGCTGTGGCC; TRAC sgRNA (SEQ ID

NO: 686)

(SEQ ID NO: 417)
B2M: GCTACTCTCTCTTTCTGGCC; TRAC sgRNA (SEQ ID

NO: 688).
```

Figure 56A:
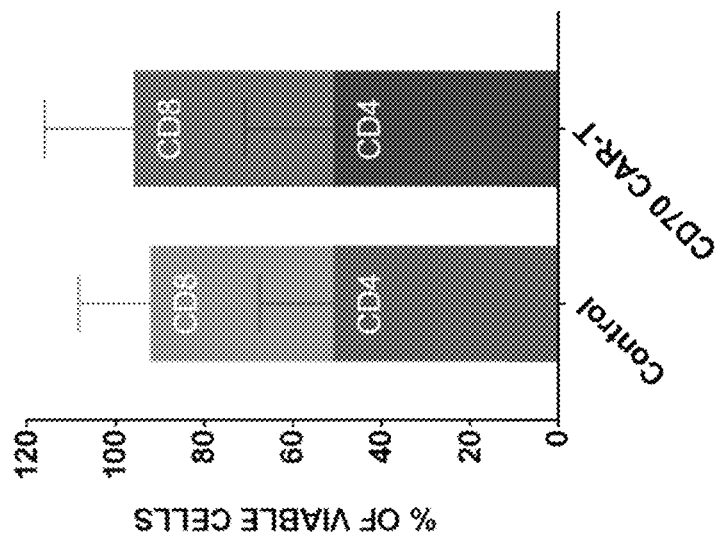
FIG. 56A is a graph demonstrating that high editing rates are achieved at the TRAC and β2M loci resulting in decreased surface expression of TCR and MHC-I. Highly efficient site-specific integration and expression of the CAR from the TRAC locus was also detected. Data are from three healthy donors.
Figure 56B:
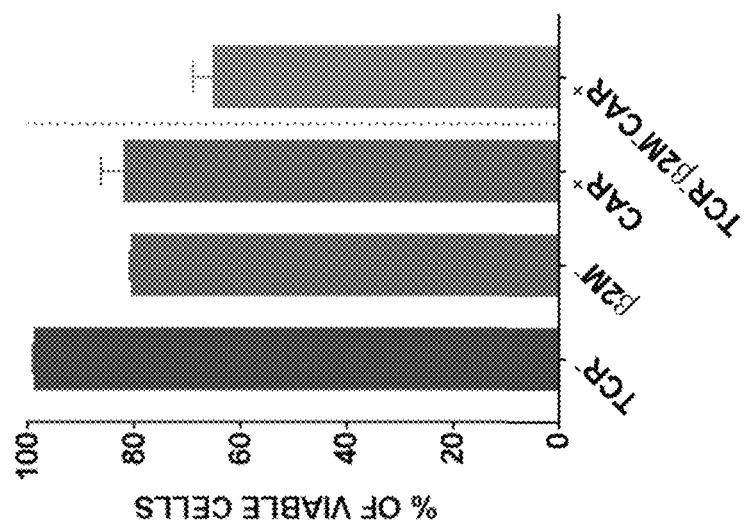
FIG. 56B is a graph demonstrating that production of allogeneic anti-CD70 CAR-T cells (TCR–β2M–CAR+) preserves CD4 and CD8 proportions.

The gRNAs used in this Example comprise the following spacer sequences: TRAC gRNA spacer (AGAGCAACA-GUGCUGUGGCC (SEQ ID NO: 152)); and B2M gRNA spacer (GCUACUCUCUCUUUCUGGCC (SEQ ID NO: 466)). FIG. 56A shows that high editing rates were achieved at the TRAC and (32M loci resulting in decreased surface expression of TCR and MHC-I. Highly efficient site-specific integration and expression of the anti-CD70 CAR from the TRAC locus was also detected. Data are from three healthy donors. FIG. 56B shows that production of allogeneic anti-CD70 CAR-T cells (TCR–β2M–CAR+) preserves CD4 and CD8 proportions.

Anti-CD70 CAR-T Cells Kill Multiple Myeloma Cells

Figure 57:
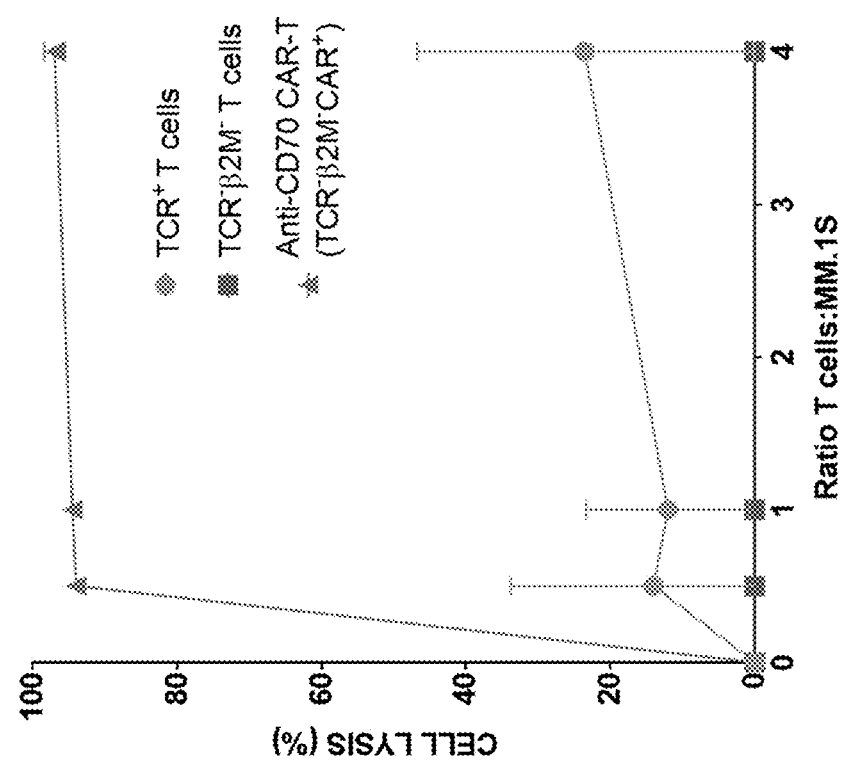
FIG. 57 is a graph demonstrating that allogeneic anti-CD70 CAR-T cells (TCR–β2M–CAR+) show potent cytotoxicity against the CD70+ MM.1S multiple myeloma-derived cell line.

To assess the ability of TRAC⁻B2M⁻/anti-CD70 CAR+ T cells to kill a CD70-expressing multiple myeloma cell line (MM.1S), a flow cytometry-based cell killing assay was designed, similar to the assay described in Examples 21 and 29. The TRAC⁻/B2M⁻/anti-CD70 CAR+ T cells were co-cultured with cells of the BCMA-expressing MM.1s multiple myeloma cell line. FIG. 57 shows that allogeneic anti-CD70 CAR-T cells (TCR–β2M–CAR+) show potent cytotoxicity against the CD70+ MM.1S multiple myeloma-derived cell line.

Example 31—Comparison of Anti-BCMA (CD28) CAR and Anti-BCMA (4-1BB) CAR

CAR Expression

Figure 67:
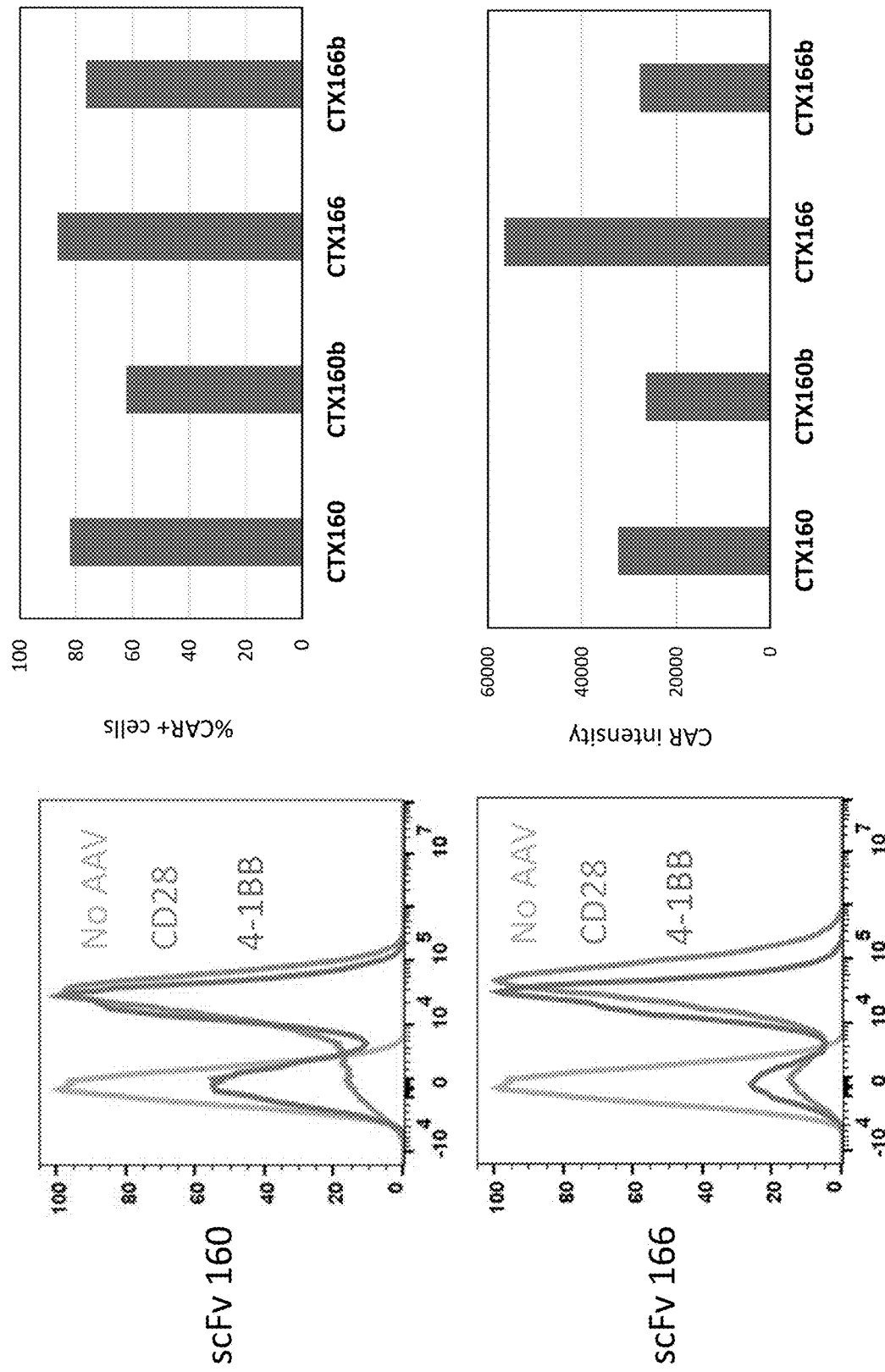
FIG. 67 is a graph showing anti-BCMA (CD28 v. 4-1BB) CAR expression in edited T cells.

Allogeneic TRAC–/B2M–/anti-BCMA CAR T+ cells were generated, as described above, having either a CD28 co-stimulatory domain (encoded by CTX-160 or CTX-166) or a 4-1BB co-stimulatory domain (encoded by CTX160b or CTX166b). Anti-BCMA CAR expression was measured by determining the percent of cells that bound biotinylated BCMA subsequently detected by FACS using streptavidin-APC (FIG. 67). Greater than 60% of the cells expressed the CAR at the cell surface.

Cytotoxicity

To assess the ability of the same TRAC⁻/B2M⁻/anti-BCMA (CD28 v. 4-1BB) CAR+ T cells to selectively kill a BCMA expressing multiple myeloma cell line (MM.1S), a flow cytometry based cell killing assay was designed, similar to the assay described in Example 21. The TRAC⁻/B2M⁻/anti-BCMA CAR+ T cells were co-cultured with cells of the BCMA-expressing MM.1S multiple myeloma cell line.

Target cells per μL were then calculated from analyzed flow cytometry data:

Cells/μL=((number of live target cell events)/(number of bead events))×((Assigned bead count of lot (beads/50 μL))/(volume of sample))

Total target cells were calculated by multiplying cells/μL×the total volume of cells.

The percent cell lysis was then calculated with the following equation:

% Cell lysis=(1–((Total Number of Target Cells in Test Sample)/(Total Number of Target Cells in Control Sample))×100.

Figure 68:
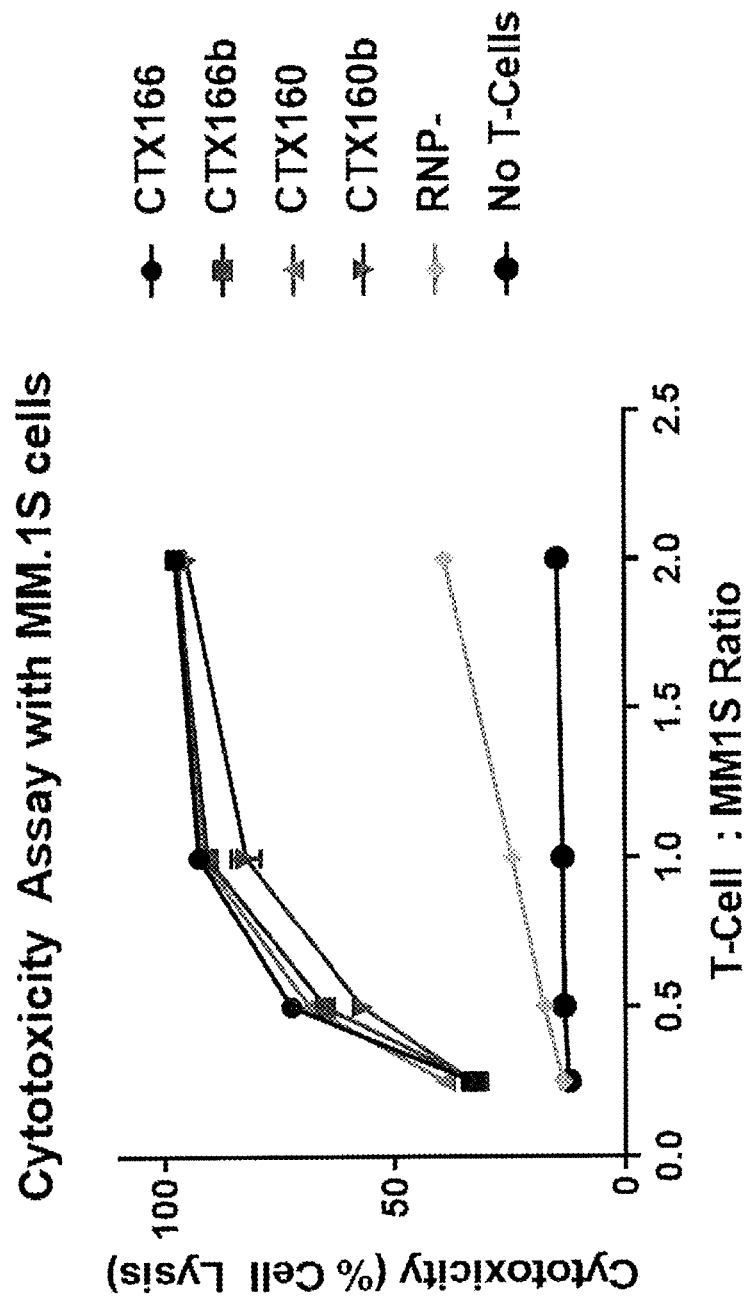
FIG. 68 is a graph showing results from a cytotoxicity assay with MM.1S cells and TRAC−/B2M−/anti-BCMA (CD28 or 4-1BB) CAR+ T cells.

FIG. 68 shows that all TRAC–/B2M–/anti-BCMA CAR+ T cells killed MM.1S cells. The results indicate that the CRISPR/Cas9 modified T cells described herein, induce potent cell lysis in a BCMA-expressing multiple myeloma cell line.

Interferon Gamma Secretion

The ability of the engineered TRAC–/B2M–/anti-BCMA (CD28 v. 4-1BB) CAR+ T cells to produce interferon gamma (IFNγ) in response to target cells was analyzed using an ELISA assay, as described above and in Examples, 10, 18, and 21.

Figure 69:
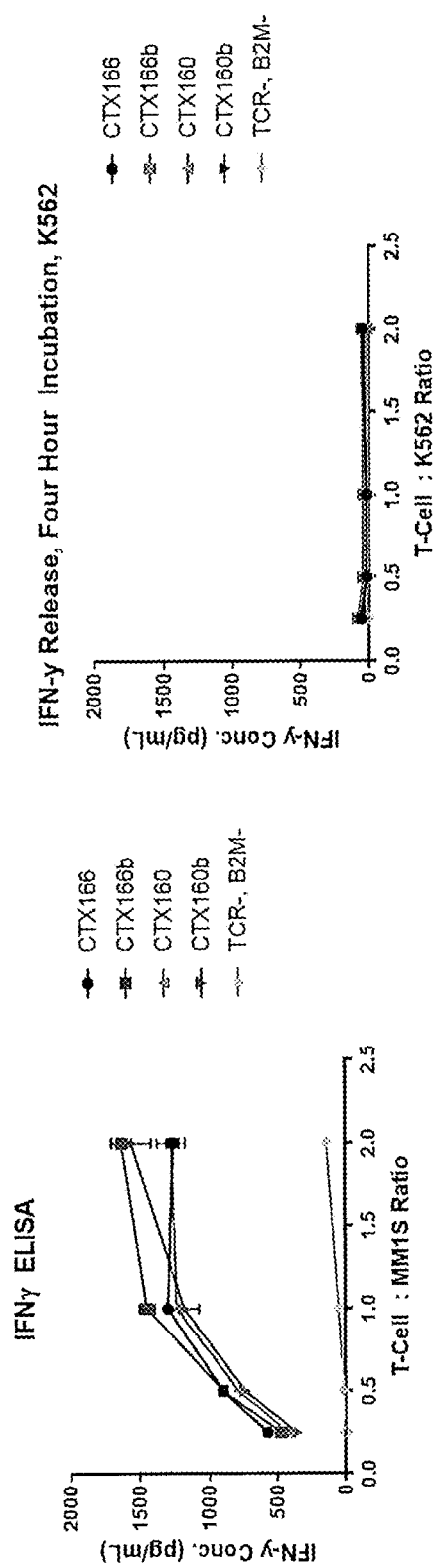
FIG. 69 includes graphs showing results from an IFN-γ secretion study with MM.1S cells (left) or K562 cells (right) and TRAC−/B2M−/anti-BCMA (CD28 or 4-1BB) CAR+ T cells.

The specificity of genetically modified T cells was evaluated in an in vitro ELISA assay. IFNγ from supernatants of cell co-cultures was measured. MM.1S cells were cultured with genetically engineered T cells expressing the anti-BCMA CAR, or controls. FIG. 69 demonstrates that all TRAC⁻/B2M⁻/anti-BCMA CAR+ T cells secrete higher levels of IFNγ when cultured with MM.1S cells as compared to T cells that do not express the anti-BCMA CAR (unedited T cells). By contrast, the TRAC⁻/B2M⁻/anti-BCMA CAR+ T cells do not secrete IFNγ or IL-2 when cultured with K562 cells (cells that do not express BCMA).

Thus, not only do the anti-BCMA CAR T cells of the present disclosure produce IFNγ, they do so specifically in the presence of BCMA-expressing cells.

Cell Kill Assay

To assess the ability of TRAC⁻/B2M⁻/anti-BCMA (4-1BB) CAR+ T cells to kill suspension cell lines, a flow cytometry-based cell killing assay was designed. The TRAC⁻/B2M⁻/anti-BCMA CAR+ T cells were co-cultured with cells of the BCMA-expressing RPMI-8226 (ATCC Cat # ATCC-155) human plasmacytoma target cell line, cells of the BCMA-expressing U-266 cell line, cells of the multiple myeloma cell line H929, or cells of the K562 cell line, which do not express BCMA (collectively referred to as the "target cells". The target cells were labeled with 5 µM efluor670 (eBiosciences), washed and incubated in co-cultures with the TRAC−/B2M−/anti-BCMA CAR+ T cells at varying ratios (from 0.1:1 to 8:1 T cells to target cells) at 50,000 target cells per well of a U-bottom 96-well plate overnight. The next day wells were washed, media was replaced with 200 µL of media containing a 1:500 dilution of 5 mg/mL DAPI (Molecular Probes) (to enumerate dead/dying cells). Finally, 25 µL of CountBright beads (Life Technologies) was added to each well. Cells were then processed by flow cytometry.

Target cells per µL were then calculated from analyzed flow cytometry data:

Cells/µL=((number of live target cell events)/(number of bead events))×((Assigned bead count of lot (beads/50 µL))/(volume of sample))

Total target cells were calculated by multiplying cells/µL×the total volume of cells.

The percent cell lysis was then calculated with the following equation:

% Cell lysis=(1−((Total Number of Target Cells in Test Sample)/(Total Number of Target Cells in Control Sample))×100

Figure 70:
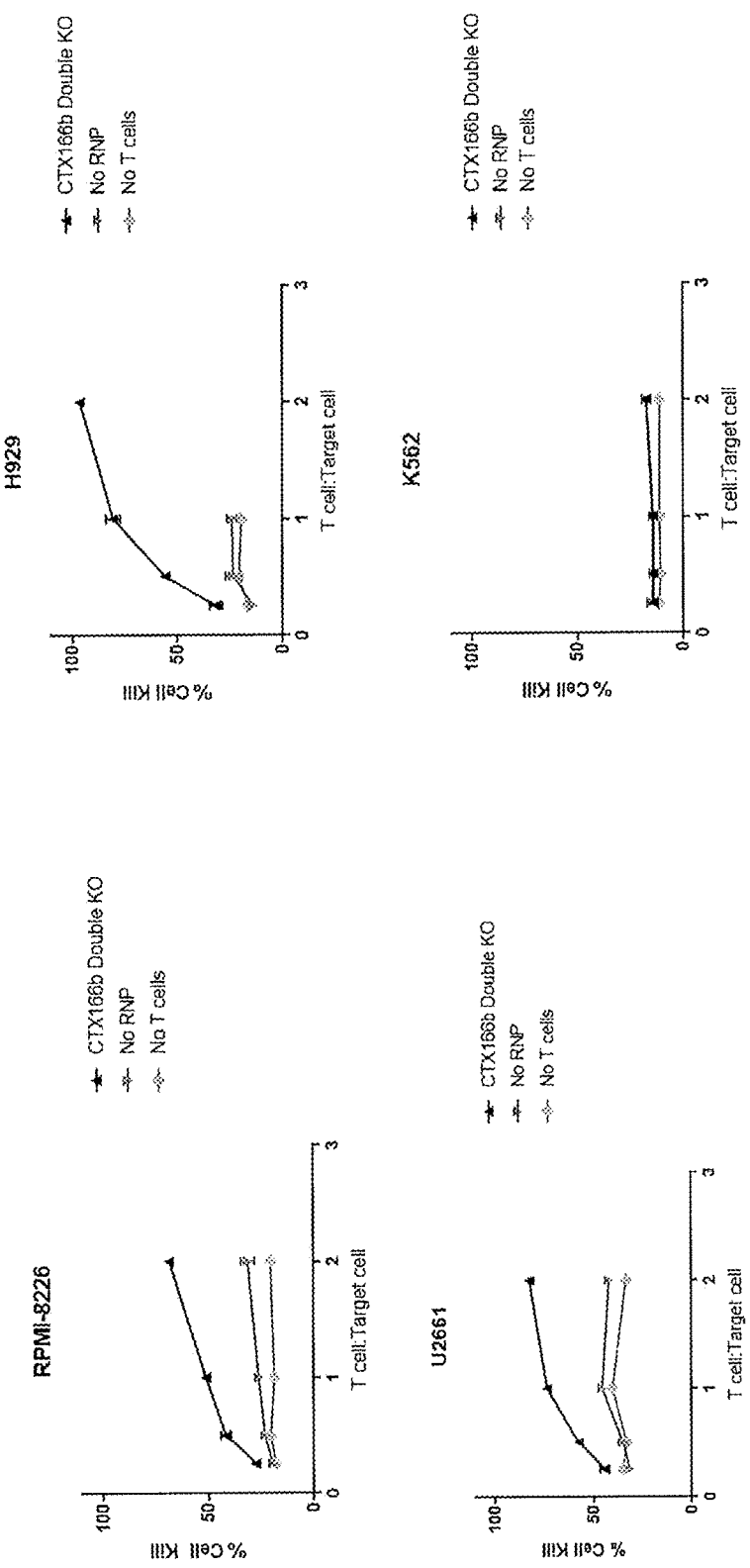
FIG. 70 includes graphs showing results from a cell kill assay using TRAC−/B2M−/anti-BCMA (4-1BB) CAR+ T cells with RPMI-8226 cells (top left), H929 cells (top right), U2661 cells (bottom left), or K562 cells (bottom right).

FIG. 70 shows that TRAC−/B2M−/anti-BCMA (4-1BB) CAR+ T cells selectively killed RPMI 8226 cells, U-266 cells, and H929 cells, with no specific toxicity toward K562 cells (which lack BCMA expression). The results indicate that the CRISPR/Cas9 modified T cells induce potent cell lysis in BCMA expressing plasmacytoma cell line.

Interferon Gamma and IL-2 Stimulation

The ability of the TRAC−/B2M−/anti-BCMA (4-1BB) CAR+ T cells to produce interferon gamma (IFNγ) in a target cell was analyzed using an ELISA assay, as described above and in Example 10 and 18.

Figure 71:
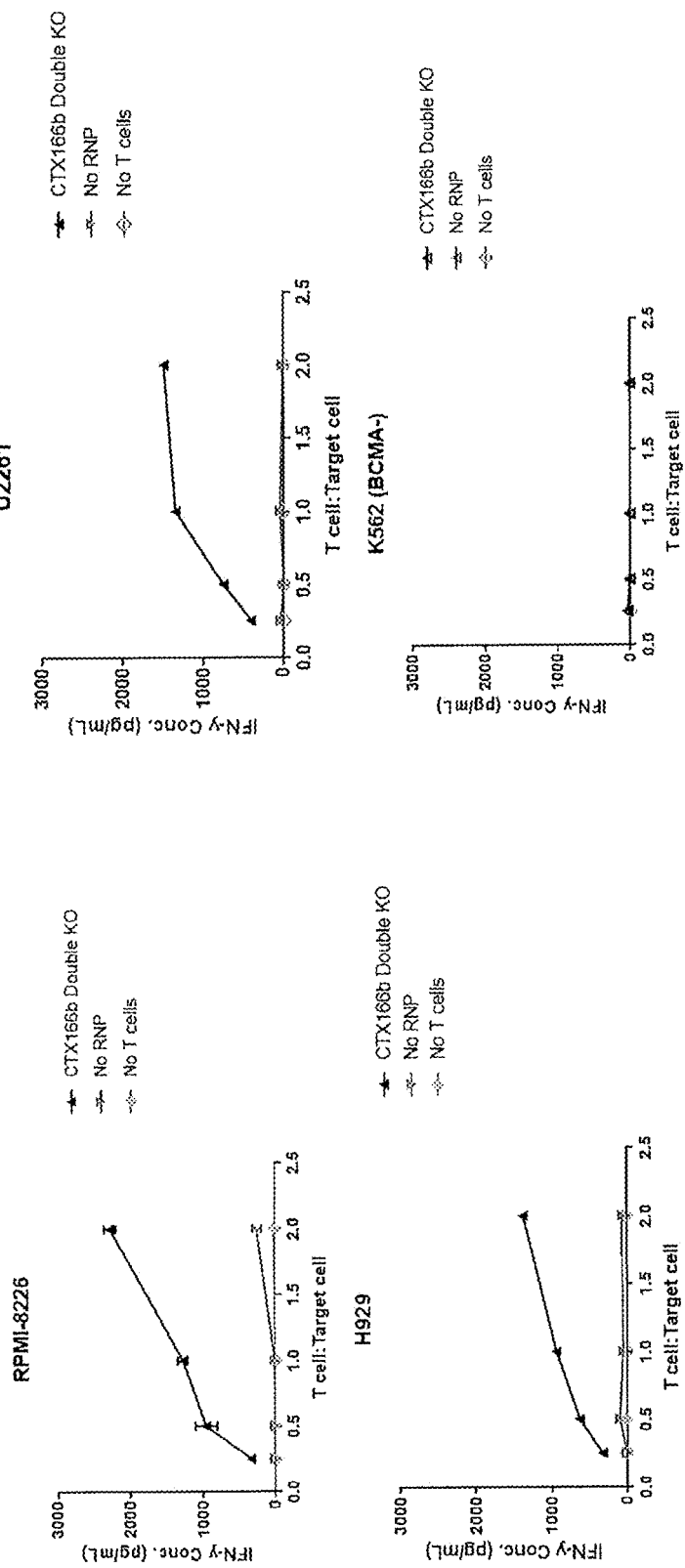
FIG. 71 includes graphs showing IFN-γ stimulation studies in the presence of TRAC−/B2M−/anti-BCMA (4-1BB) CAR+ T cells with RPMI-8226 cells (top left), U2261 cells (top right), H929 cells (bottom left), or K562 cells (bottom right).
Figure 72:
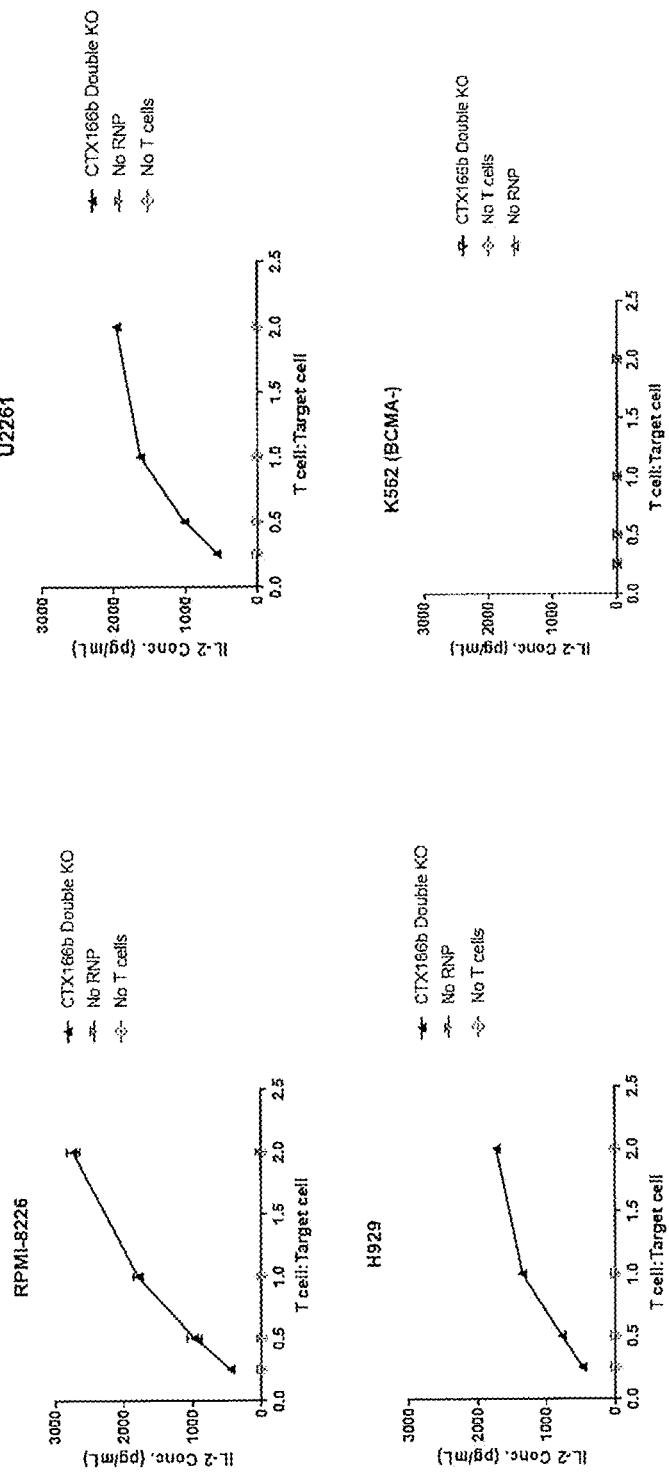
FIG. 72 includes graphs showing IL-2 stimulation studies in the presence of TRAC−/B2M−/anti-BCMA (4-1BB) CAR+ T cells with RPMI-8226 cells (top left), U2261 cells (top right), H929 cells (bottom left), or K562 cells (bottom right).
Figure 73:
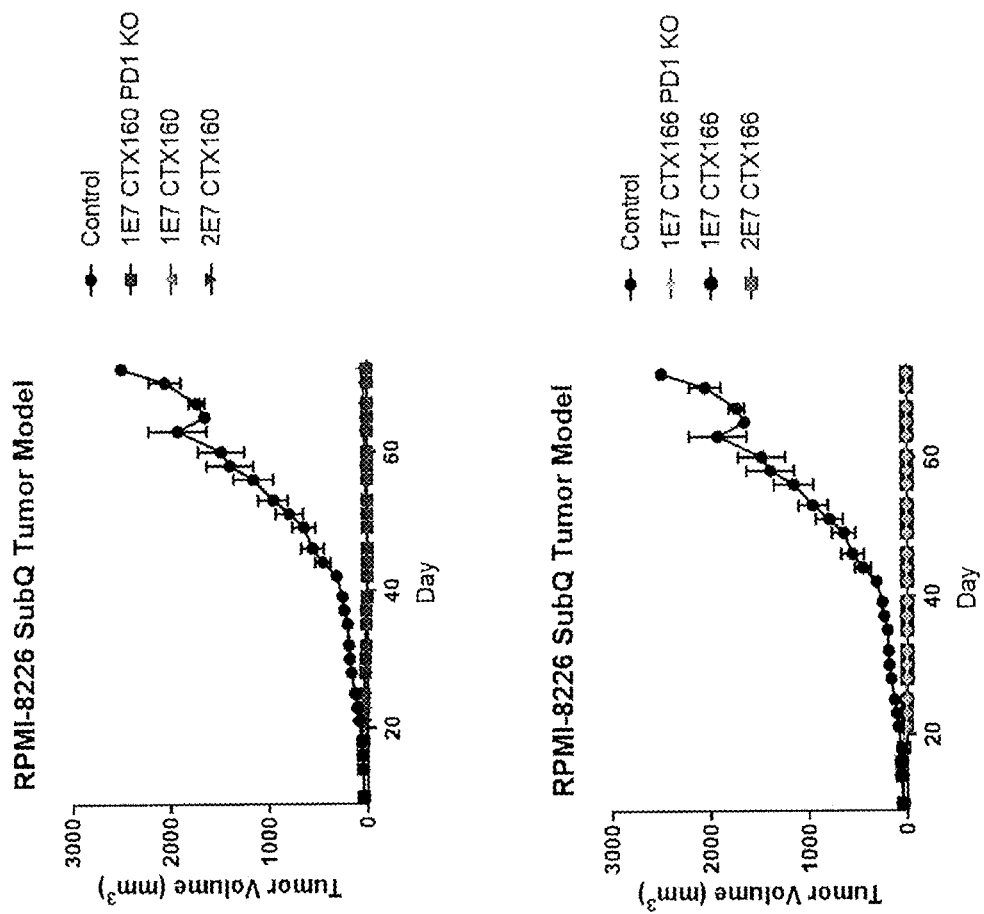
FIG. 73 includes graphs showing tumor volume in a RPMI-8226 subcutaneous tumor mouse model administered TRAC−/B2M−/anti-BCMA (CD28) CAR+ T cells or TRAC−/B2M−/PD-1−/anti-BCMA (CD28) CAR+ T cells.
Figure 74:
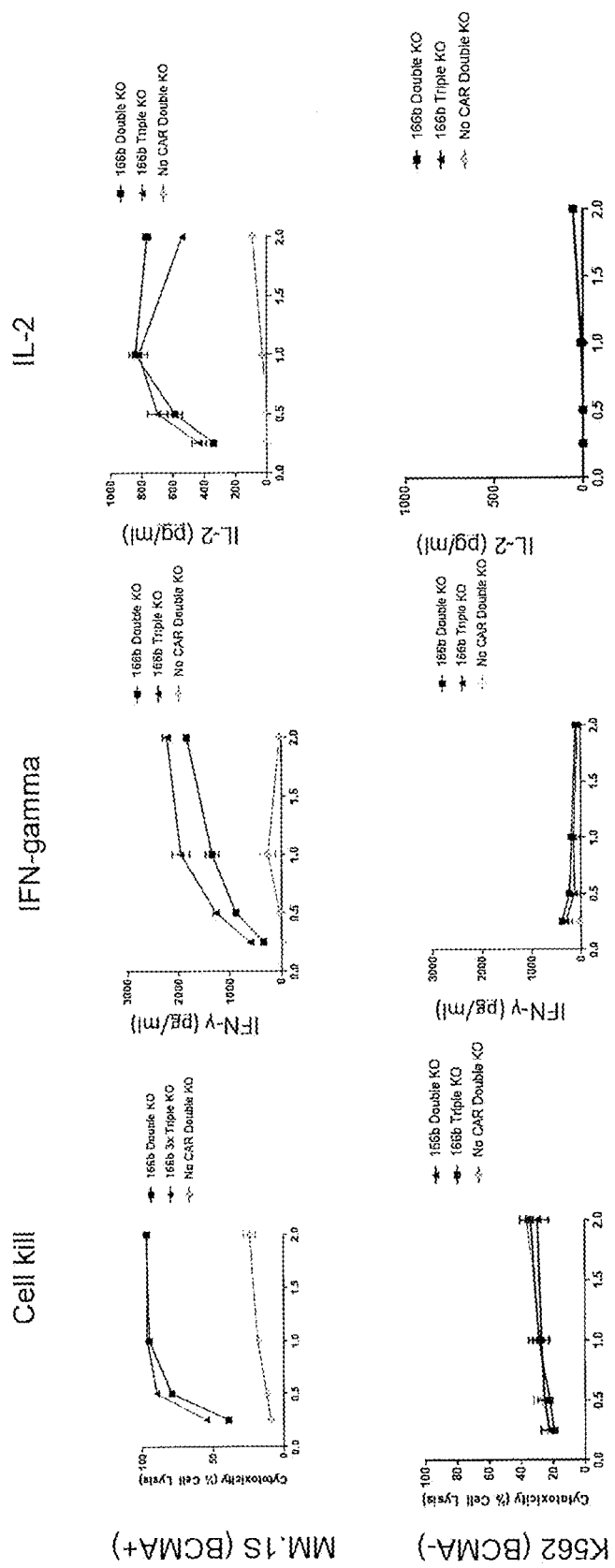
FIG. 74 includes graphs showing results from cytotoxicity (left), IFN-γ stimulation (middle), and IL-2 stimulation studies with TRAC−/B2M−/anti-BCMA (4-1BB) CAR+ T cells or TRAC−/B2M−/PD-1−/anti-BCMA (4-1BB) CAR+ T cells in the presence of MM.1S cells or K562 cells.

The specificity of genetically modified T cells expressing an anti-BCMA CAR integrated into the TRAC gene, was evaluated in an in vitro ELISA assay. IFNγ and IL-2 from supernatants of cell co-cultures was measured. Target RPMI-8226, U2261, H929, or K562 cells were cultured with genetically engineered T cells expressing the anti-BCMA CAR, or controls. FIGS. 73 and 74 demonstrates that TRAC−/B2M−/anti-BCMA CAR+ T cells secrete higher levels of IFNγ (FIG. 71) and IL-2 (FIG. 72) when cultured with each of the target cell lines, as compared to T cells that do not express the anti-BCMA CAR (no RNP) (at a 0.5:1, 1:1, 1.5:1, 2:1, and 2.5:1 CAR-T cell to target ratio), with the exception of the K562 cell line. Thus, not only do the TRAC−/B2M−/anti-BCMA (4-1BB) CAR+ T cells of the present disclosure produce IFNγ and IL-2, they do so specifically in the presence of BCMA-expressing cells.

Similar studies as above were repeated using TRAC−/B2M−/anti-BCMA (4-1BB) CAR+ T cells compared to TRAC−/B2M−/PD-1−/anti-BCMA (4-1BB) CAR+ T cells. The edited cells were assayed with MM.1S cells or K562 cells for cytotoxicity, IFN-γ stimulation, and IL-2 stimulation. The results are depicted in FIG. 74, showing that the edited cells induce potent cell lysis specifically in the BCMA-expressing K562 cell line, and they produce IFNγ and IL-2 specifically in the presence of BCMA-expressing cells (FIG. 74).

Example 32—In Vivo Tumor Model for Anti-BCMA CAR in Context of PD-1 Knockout

The efficacy of TRAC−/B2M−/anti-BCMA (CD28 co-stim) CAR+ T cells and TRAC−/B2M−/PD-1−/anti-BCMA (CD28 co-stim) CAR+ T cells against the subcutaneous RPMI-8226 tumor xenograft model in NOG mice was evaluated. In brief, thirty five (35), 5-8 week old female, CIEA NOG (NOD.Cg-Prkdc$^{scid}$Il2rg$^{tm1Sug}$/JicTac) mice were individually housed in ventilated microisolator cages, maintained under pathogen-free conditions, 5-7 days prior to the start of the study. On Day 1 mice received a subcutaneous inoculation of 10×10$^6$ RPMI-8226 cells/mouse. Ten (10) days post inoculation with RPMI-8226 cells, the mice were divided into 6 treatment groups (N=5) and dosed as indicated in Table 30.

TABLE 30

| Group | CAR T Cell | # of T Cells injected | N |
|---|---|---|---|
| 1 | N/A | N/A | 4 |
| 2 | TRAC−/B2M−/PD1−/CTX160 | 1 × 10$^7$ cells/mouse | 4 |
| 3 | TRAC−/B2M−/CTX160 | 1 × 10$^7$ cells/mouse | 4 |
| 4 | TRAC−/B2M−/CTX160 | 2 × 10$^7$ cells/mouse | N |
| 5 | TRAC−/B2M−/PD1−/CTX166 | 1 × 10$^7$ cells/mouse | 4 |
| 6 | TRAC−/B2M−/CTX166 | 1 × 10$^7$ cells/mouse | 4 |
| 7 | TRAC−/B2M−/CTX166 | 2 × 10$^7$ cells/mouse | 4 |

Tumor volume and body weight was measured and individual mice were euthanized when tumor volume was ≥500 mm$^3$. By Day 18, the data show a statistically significant decrease in the tumor volume in response to TRAC−/B2M−/anti-BCMA (CD28 co-stim) CAR+ T cells and TRAC−/B2M−/PD-1−/anti-BCMA (CD28 co-stim) CAR+ T cells as compared to untreated mice (FIG. 73).

Example 33—Efficacy of TRAC−/B2M−/Anti-CD70 CAR+ T Cells or TRAC−/B2M−/PD1−/Anti-CD70 CAR+ T Cells, with CD28 or 41BB Costimulatory Domains: The Subcutaneous Renal Cell Carcinoma Tumor Xenograft Model in NOG Mice NOG mice were injected subcutaneously with 5×10$^6$ A498 renal cell carcinoma cells. When tumors reached ~150 mm$^3$, mice were either left untreated or injected intravenously (I.V.) with a therapeutic dose of 1×10$^7$ anti-CD70 CAR-T cells. Tumor volumes were measured every 2 days for the duration of the study. Injection of anti-CD70 CART cells lead to decreased tumor volumes (FIG. 75) before the tumors grow again. These data show that TRAC−/B2M− or TRAC−/B2M−/PD1− anti-CD70 CAR+ T cells, with CD28 or 41BB costimulatory domains, have similar anti-tumor activity against CD70+ kidney cancer tumors in vivo.

The anti-CD70 CAR+T cells were generated as described above in Example 18. Furthermore the in vivo study was conducted similarly to the one described in Example 25. The ability of the modified TRAC−/B2M− or TRAC−/B2M−/PD1− anti-CD70CAR+ T cells, with CD28 or 41BB co-stimulatory domains, to ameliorate disease caused by a CD70+ renal carcinoma cell line was evaluated in NOG mice using methods employed by Translational Drug Development, LLC (Scottsdale, Ariz.). In brief, 5-8 week old females, CIEA NOG (NOD.Cg-Prkdc$^{scid}$Il2rg$^{tm1Sug}$/JicTac) mice were individually housed in ventilated microisolator cages, maintained under pathogen-free conditions, 5-7 days prior to the start of the study. On Day 1 mice received a subcutaneous inoculation of 5×10$^6$ A498 renal carcinoma cells/mouse. The mice were further divided into 5 treatment groups as shown in Table 31. When tumors reach ~150 mm$^3$, treatment groups 2, 3, 4 and 5 received a single 200 µl intravenous dose of TRAC−/anti-CD70CAR+cells according to Table 31.

TABLE 31

Treatment groups

| Group | A498 cells | T cell treatment (i.v.) | N |
|---|---|---|---|
| 1. | 5 × 10⁶ cells/mouse | None | 12 |
| 2. CD28, TRAC-B2M- | 5 × 10⁶ cells/mouse | 1 × 10⁷ cells/mouse | 5 |
| 3. CD28, TRAC-B2M- PD1- | 5 × 10⁶ cells/mouse | 1 × 10⁷ cells/mouse | 5 |
| 4. 41BB, TRAC-, B2M- | 5 × 10⁶ cells/mouse | 1 × 10⁷ cells/mouse | 5 |
| 5. 41BB, TRAC-, B2M-, PD1- | 5 × 10⁶ cells/mouse | 1 × 10⁷ cells/mouse | 5 |

Tumor volumes were measured every 2 days. These data demonstrate that TRAC-/B2M- or TRAC-/B2M-/PD1- anti-CD70 CAR+ T cells, with CD28 or 41BB costimulatory domains, have similar anti-tumor activity against CD70+ kidney cancer tumors in vivo.

Figure 75:
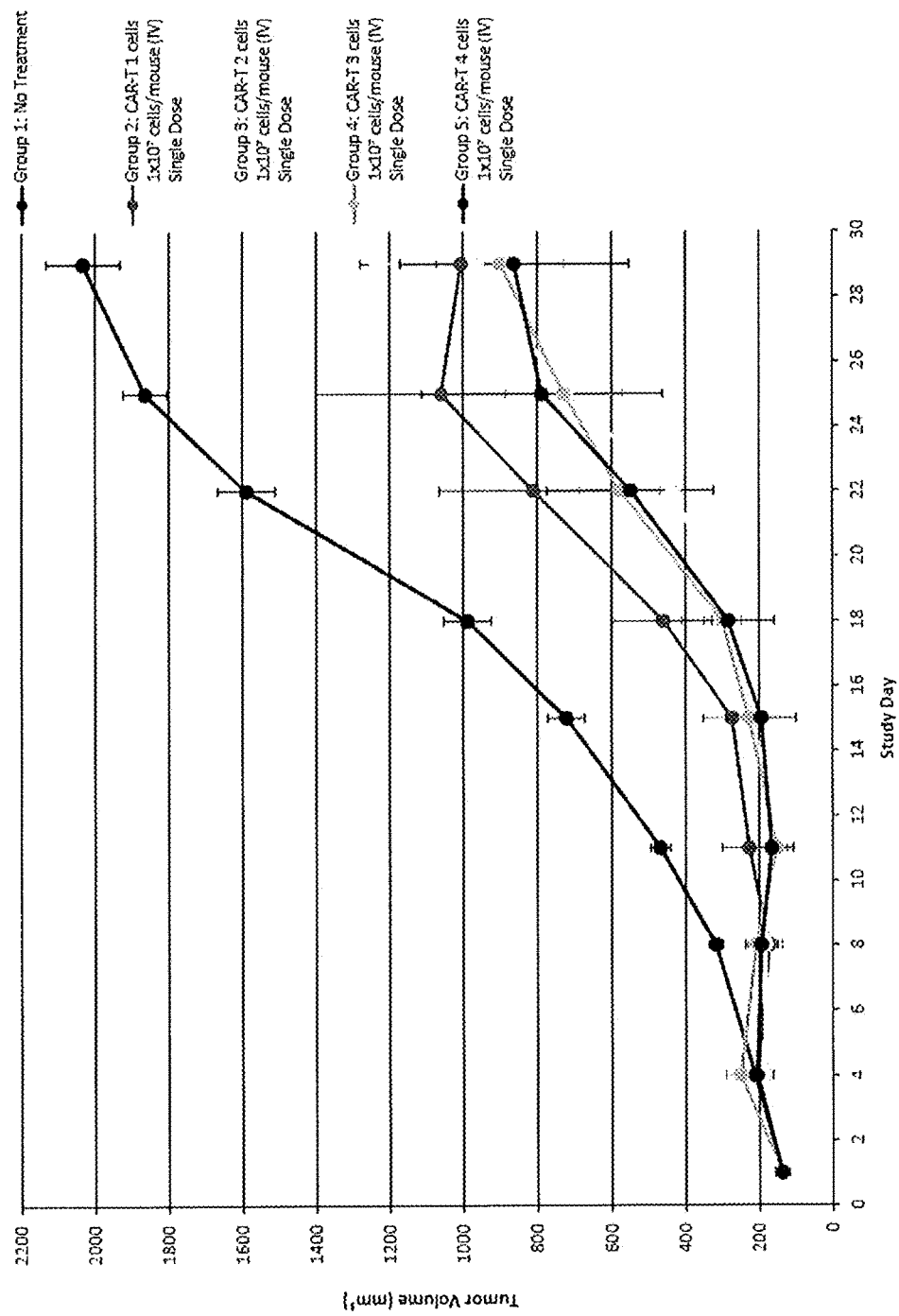
FIG. 75 includes a graph showing that TRAC−/B2M−/anti-CD70 CAR+ or TRAC−/B2M−/PD1−/anti-CD70 CAR+ T Cells, with a CD28 or a 41BB costimulatory domain, display anti-tumor activity in a renal cell carcinoma mouse model.

FIG. 75 is a graph depicting similar decrease in tumor volume (mm³) following treatment of NOG mice that were injected subcutaneously with A498 renal cell carcinoma cell lines with TRAC-/B2M- or TRAC-/B2M-/PD1- anti-CD70 CAR+ T cells, with CD28 or 41BB costimulatory domains. All Groups of NOG mice were injected with 5×10⁶ cells/mouse. Group 1 received no T cell treatment. Mice in Group 2 were treated intravenously with 1×10⁷ cell/mouse of TRAC-/B2M- anti-CD70 CAR+ T cells, with CD28 costimulatory domain, when tumors reached ~150 mm³. Mice in Group 3 were treated intravenously with 2×10⁷ cell/mouse of TRAC-/B2M-/PD1- anti-CD70 CAR+ T cells, with CD28 costimulatory domain, when tumors reached ~150 mm³. Mice in Group 3 were treated intravenously with 1×10⁷ cell/mouse of TRAC-/B2M- anti-CD70 CAR+ T cells, with 41BB costimulatory domain, when tumors reached ~150 mm³. Mice in Group 4 were treated intravenously with 2×10⁷ cell/mouse of TRAC-/B2M-/PD1- anti-CD70 CAR+ T cells, with 41BB costimulatory domain, when tumors reached ~150 mm³

TABLE 32

Modified sgRNAs

| SEQ ID NO: | DESCRIPTION | SEQUENCE(*: indicates a nucleotide with a 2'-O'methyl phosphorothioate modification) |
|---|---|---|
| 1342 | TRAC modified sgRNA | A*G*A*GCAACAGUGCUGUGGCCGUUUUAGAGCUAGAAAUAGCAAGUUAAAAUAAGGCUAGUCCGUUAUCAACUUGAAAAAGUGGCACCGAGUCGGUGCU*U*U*U |
| 1343 | TRAC unmodified sgRNA | AGAGCAACAGUGCUGUGGCCGUUUUAGAGCUAGAAAUAGCAAGUUAAAAUAAGGCUAGUCCGUUAUCAACUUGAAAAAGUGGCACCGAGUCGGUGCUUUU |
| 1344 | B2M modified sgRNA | G*C*U*ACUCUCUCUUUCUGGCCGUUUUAGAGCUAGAAAUAGCAAGUUAAAAUAAGGCUAGUCCGUUAUCAACUUGAAAAAGUGGCACCGAGUCGGUGCU*U*U*U |
| 1345 | B2M unmodified sgRNA | GCUACUCUCUCUUUCUGGCCGUUUUAGAGCUAGAAAUAGCAAGUUAAAAUAAGGCUAGUCCGUUAUCAACUUGAAAAAGUGGCACCGAGUCGGUGCUUUU |
| 1346 | AAVS1 modified sgRNA | G*G*G*GCCACUAGGGACAGGAUGUUUUAGAGCUAGAAAUAGCAAGUUAAAAUAAGGCUAGUCCGUUAUCAACUUGAAAAAGUGGCACCGAGUCGGUGCU*U*U*U |
| 1347 | AAVS1 unmodified sgRNA | GGGGCCACUAGGGACAGGAUGUUUUAGAGCUAGAAAUAGCAAGUUAAAAUAAGGCUAGUCCGUUAUCAACUUGAAAAAGUGGCACCGAGUCGGUGCUUUU |
| 1574 | PD1 modified sgRNA | C*U*G*CAGCUUCUCCAACACAUGUUUUAGAGCUAGAAAUAGCAAGUUAAAAUAAGGCUAGUCCGUUAUCAACUUGAAAAAGUGGCACCGAGUCGGUGCU*U*U*U |
| 1575 | PD1 unmodified sgRNA | CUGCAGCUUCUCCAACACAUGUUUUAGAGCUAGAAAUAGCAAGUUAAAAUAAGGCUAGUCCGUUAUCAACUUGAAAAAGUGGCACCGAGUCGGUGCUUUU |
| 1587 | TRAC modified sgRNA | G*A*G*AAUCAAAAUCGGUGAAUGUUUUAGAGCUAGAAAUAGCAAGUUAAAAUAAGGCUAGUCCGUUAUCAACUUGAAAAAGUGGCACCGAGUCGGUGCU*U*U*U |
| 1588 | TRAC unmodified sgRNA | GAGAAUCAAAAUCGGUGAAUGUUUUAGAGCUAGAAAUAGCAAGUUAAAAUAAGGCUAGUCCGUUAUCAACUUGAAAAAGUGGCACCGAGUCGGUGCUUUU |

TABLE 33

| | | Constructs | | | | | |
|---|---|---|---|---|---|---|---|
| Name | Description | rAAV Table 34 | LHA to RHA Table 35 | CAR Nucleotide Table 36 SEQ ID NOs. | CAR Amino Acid Table 37 | scFv Nucleotide Table 38 | scFv Amino Acid Table 39 |
| CTX-131 | Anti-CD19 (GFP) | 1348 | 1387 | 1316 | 1338 | 1333 | 1334 |
| CTX-132 | Anti-CD19 (GFP) | 1349 | — | 1316 | 1338 | 1333 | 1334 |
| CTX-133 | Anti-CD19 (GFP) | 1350 | 1388 | 1316 | 1338 | 1333 | 1334 |
| CTX-134 | Anti-CD19 (GFP) | 1351 | — | 1316 | 1338 | 1333 | 1334 |
| CTX-135 | Anti-CD19 (GFP) | 1352 | 1389 | 1316 | 1338 | 1333 | 1334 |
| CTX-136 | Anti-CD19 (GFP) | 1353 | — | 1316 | 1338 | 1333 | 1334 |
| CTX-138 | Anti-CD19 (no GFP) | 1354 | 1390 | 1316 | 1338 | 1333 | 1334 |
| CTX-139 | Anti-CD19 (no GFP) | 1355 | 1391 | 1316 | 1338 | 1333 | 1334 |
| CTX-139.1 | Anti-CD19 (no GFP) | | 1583 | 1316 | 1338 | 1333 | 1334 |
| CTX-139.2 | Anti-CD19 (no GFP) | | 1584 | 1316 | 1338 | 1333 | 1334 |
| CTX-139.3 | Anti-CD19 (no GFP) | | 1585 | 1316 | 1338 | 1333 | 1334 |
| CTX-140 | Anti-CD19 (no GFP) | 1356 | 1392 | 1316 | 1338 | 1333 | 1334 |
| CTX-141 | Anti-CD19 (no GFP) | 1357 | 1393 | 1316 | 1338 | 1333 | 1334 |
| CTX-142 | Anti-CD70 (CD70A, no GFP) | 1358 | 1394 | 1423 | 1449 | 1475 | 1499 |
| CTX-145 | Anti-CD70 (CD70B, no GFP) | 1359 | 1395 | 1424 | 1450 | 1476 | 1500 |
| CTX-145b | Anti-CD70 (4-1BB) | 1360 | 1396 | 1275 | 1276 | 1476 | 1500 |
| CTX-152 | Anti-BCMA (BCMA-1, GFP) | 1361 | 1397 | 1425 | 1451 | 1477 | 1501 |
| CTX-153 | Anti-BCMA (BCMA-1, no GFP) | 1362 | 1398 | 1425 | 1451 | 1477 | 1501 |
| CTX-154 | Anti-BCMA (BCMA-2, GFP) | 1363 | 1399 | 1426 | 1452 | 1478 | 1502 |
| CTX-155 | Anti-BCMA (BCMA-2, no GFP) | 1364 | 1400 | 1426 | 1452 | 1478 | 1502 |
| CTX-160 | Anti-BCMA | 1365 | 1401 | 1427 | 1453 | 1479 | 1503 |
| CTX-160b | Anti-BCMA (4-1BB) | 1366 | 1402 | 1428 | 1454 | 1479 | 1503 |
| CTX-161 | Anti-BCMA | 1367 | 1403 | 1429 | 1455 | 1480 | 1504 |
| CTX-162 | Anti-BCMA | 1368 | 1404 | 1430 | 1456 | 1481 | 1505 |
| CTX-163 | Anti-BCMA | 1369 | 1405 | 1431 | 1457 | 1482 | 1506 |
| CTX-164 | Anti-BCMA | 1370 | 1406 | 1432 | 1458 | 1483 | 1507 |
| CTX-165 | Anti-BCMA | 1371 | 1407 | 1433 | 1459 | 1484 | 1508 |
| CTX-166 | Anti-BCMA | 1372 | 1408 | 1434 | 1460 | 1485 | 1509 |
| CTX-166b | Anti-BCMA (4-1BB) | 1373 | 1409 | 1435 | 1461 | 1485 | 1509 |
| CTX-167 | Anti-BCMA | 1374 | 1410 | 1436 | 1462 | 1486 | 1510 |
| CTX-168 | Anti-BCMA | 1375 | 1411 | 1437 | 1463 | 1487 | 1511 |
| CTX-169 | Anti-BCMA | 1376 | 1412 | 1438 | 1464 | 1488 | 1512 |
| CTX-170 | Anti-BCMA | 1377 | 1413 | 1439 | 1465 | 1489 | 1513 |
| CTX-171 | Anti-BCMA | 1378 | 1414 | 1440 | 1466 | 1490 | 1514 |
| CTX-172 | Anti-BCMA | 1379 | 1415 | 1441 | 1467 | 1491 | 1515 |
| CTX-173 | Anti-BCMA | 1380 | 1416 | 1442 | 1468 | 1492 | 1516 |
| CTX-174 | Anti-BCMA | 1381 | 1417 | 1443 | 1469 | 1493 | 1517 |
| CTX-175 | Anti-BCMA | 1382 | 1418 | 1444 | 1470 | 1494 | 1518 |
| CTX-176 | Anti-BCMA | 1383 | 1419 | 1445 | 1471 | 1495 | 1519 |
| CTX-177 | Anti-BCMA | 1384 | 1420 | 1446 | 1472 | 1496 | 1520 |
| CTX-178 | Anti-BCMA | 1385 | 1421 | 1447 | 1473 | 1497 | 1521 |
| CTX-179 | Anti-BCMA | 1386 | 1422 | 1448 | 1474 | 1498 | 1522 |

TABLE 34 rAAV Sequences

| SEQ ID NO: | Description | Sequence |
|---|---|---|
| 1348 | CTX-131 | CCTGCAGGCAGCTGCGCGCTCGCTCGCTCACTGAGGCCGCCCG<br>GGCAAAGCCCGGGCGTCGGGCGACCTTTGGTCGCCCGGCCTCA<br>GTGAGCGAGCGAGCGCGCAGAGAGGGAGTGGCCAACTCCATC<br>ACTAGGGGTTCCTGCGGCCGCACGCGTGAAGCCCAGAGCAGGG<br>CCTTAGGGAAGCGGGACCCTGCTCTGGGCGGAGGAATATGTCC<br>CAGATAGCACTGGGGACTCTTTAAGGAAAGAAGGATGGAGAA<br>AGAGAAAGGGAGTAGAGGCGGCCACGACCTGGTGAACACCTA<br>GGACGCACCATTCTCACAAAGGGAGTTTTCCACACGGACACCC<br>CCCTCCTCACCACAGCCCTGCCAGGACGGGGCTGGCTACTGGC<br>CTTATCTCACAGGTAAAACTGACGCACGGAGGAACAATATAAA<br>TTGGGGACTAGAAAGGTGAAGAGCCAAAGTTAGAACTCAGGA<br>CCAACTTATTCTGATTTTGTTTTTCCAAACTGCTTCTCCTCTTGG<br>GAAGTGTAAGGAAGCTGCAGCACCAGGATCAGTGAAACGCAC<br>CAGACGGCCGCGTCAGAGCAGCTCAGGTTCTGGGAGAGGGTA<br>GCGCAGGGTGGCCACTGAGAACCGGGCAGGTCACGCATCCCCC<br>CCTTCCCTCCCACCCCCTGCCAAGCTCTCCCTCCCAGGATCCTC<br>TCTGGCTCCATCGTAAGCAAACCTTAGAGGTTCTGGCAAGGAG<br>AGAGATGGCTCCAGGAAATGGGGGTGTGTCACCAGATAAGGA<br>ATCTGCCTAACAGGAGGTGGGGGTTAGACCCAATATCAGGAGA<br>CTAGGAAGGAGGAGGCCTAAGGATGGGGCTTTTCTGTCACCAG<br>CCACTAGTGGCCGCCAGTGTGATGGATATCTGCAGAATTCGCC<br>CTTATGGGGATCCGAACAGAGAGACAGCAGAATATGGGCCAA<br>ACAGGATATCTGTGGTAAGCAGTTCCTGCCCCGGCTCAGGGCC<br>AAGAACAGTTGGAACAGCAGAATATGGGCCAAACAGGATATC<br>TGTGGTAAGCAGTTCCTGCCCCGGCTCAGGGCCAAGAACAGAT<br>GGTCCCCAGATGCGGTCCCGCCCTCAGCAGTTTCTAGAGAACC<br>ATCAGATGTTTCCAGGGTGCCCCAAGGACCTGAAATGACCCTG<br>TGCCTTATTTGAACTAACCAATCAGTTCGCTTCTCGCTTCTGTTC<br>GCGCGCTTCTGCTCCCCGAGCTCTATATAAGCAGAGCTCGTTTA<br>GTGAACCGTCAGATCGCCTGGAGACGCCATCCACGCTGTTTTG<br>ACCTCCATAGAAGACACCGACTCTAGAGGGACCATGCTTCTTT<br>TGGTTACGTCTCTGTTGCTTTGCGAACTTCCTCATCCAGCGTTCT<br>TGCTGATCCCCGATATTCAGATGACTCAGACCACCAGTAGCTT<br>GTCTGCCTCACTGGGAGACCGAGTAACAATCTCCTGCAGGGCA<br>AGTCAAGACATTAGCAAATACCTCAATTGGTACCAGCAGAAGC<br>CCGACGGAACGGTAAAACTCCTCATCTATCATACGTCAAGGTT<br>GCATTCCGGAGTACCGTCACGATTTTCAGGTTCTGGGAGCGGA<br>ACTGACTATTCCTTGACTATTTCAAACCTCGAGCAGGAGGACA<br>TTGCGACATATTTTTGTCAACAAGGTAATACCCTCCCTTACACT<br>TTCGGAGGAGGAACCAAACTCGAAATTACCGGGTCCACCAGTG<br>GCTCTGGGAAGCCTGGCAGTGGAGAAGGTTCCACTAAAGGCGA<br>GGTGAAGCTCCAGGAGAGCGGCCCCGGTCTCGTTGCCCCCAGT<br>CAAAGCCTCTCTGTAACGTGCACAGTGAGTGGTGTATCATTGC<br>CTGATTATGGCGTCTCCTGGATAAGGCAGCCCCCGCGAAAGGG<br>TCTTGAATGGCTTGGGGTAATATGGGGCTCAGAGACAACGTAT<br>TATAACTCCGCTCTCAAAAGTCGCTTGACGATAATAAAAGATA<br>ACTCCAAGAGTCAAGTTTTCCTTAAAATGAACAGTTTGCAGAC<br>TGACGATACCGCTATATATTATTGTGCTAAACATTATTACTACG<br>GCGGTAGTTACGCGATGGATTATTGGGGGCAGGGGACTTCTGT<br>CACAGTCAGTAGTGCTGCTGCCTTTGTCCCGGTATTTCTCCCAG<br>CCAAACCGACCACGACTCCCGCCCCGCGCCCTCCGACACCCGC<br>TCCCACCATCGCCTCTCAACCTCTTAGTCTTCGCCCCGAGGCAT<br>GCCGACCCGCCGCCGGGGGTGCTGTTCATACGAGGGGCTTGGA<br>CTTCGCTTGTGATATTTACATTTGGGCTCCGTTGGCGGGTACGT<br>GCGGCGTCCTTTTGTTGTCACTCGTTATTACTTTGTATTGTAATC<br>ACAGGAATCGCTCAAAGCGGAGTAGGTTGTTGCATTCCGATTA<br>CATGAATATGACTCCTCGCCGGCCTGGGCCGACAAGAAAACAT<br>TACCAACCCTATGCCCCCCCACGAGACTTCGCTGCGTACAGGT<br>CCCGAGTGAAGTTTTCCCGAAGCGCAGACGCTCCGGCATATCA<br>GCAAGGACAGAATCAGCTGTATAACGAACTGAATTTGGGACGC<br>CGCGAGGAGTATGACGTGCTTGATAAACGCCGGGGAGAGAC<br>CCGGAAATGGGGGTAAACCCCGAAGAAAGAATCCCCAAGAA<br>GGACTCTACAATGAACTCCAGAAGGATAAGATGGCGGAGGCCT<br>ACTCAGAAATAGGTATGAAGGGCGAACGACGACGGGGAAAAG<br>GTCACGATGGCCTCTACCAAGGGGTTGAGTACGGCAACCAAAGA<br>TACGTACGATGCACTGCATATGCAGGCCCTGCCTCCCAGAGGA<br>AGCGGAGCTACTAACTTCAGCCTGCTGAAGCAGGCTGGAGACG<br>TGGAGGAGAACCCTGGACCTATGGTGAGCAAGGGCGAGGAGC<br>TGTTCACCGGGGTGGTGCCCATCCTGGTCGAGCTGGACGGCGA<br>CGTAAACGGCCACAAGTTCAGCGTGTCCGGCGAGGGCGAGGG<br>CGATGCCACCTACGGCAAGCTGACCCTGAAGTTCATCTGCACC<br>ACCGGCAAGCTGCCCGTGCCCTGGCCCACCCTCGTGACCACCC<br>TGACCTACGGCGTGCAGTGCTTCAGCCGCTACCCCGACCACAT<br>GAAGCAGCACGACTTCTTCAAGTCCGCCATGCCCGAAGGCTAC<br>GTCCAGGAGCGCACCATCTTCTTCAAGGACGACGGCAACTACA<br>AGACCCGCGCCGAGGTGAAGTTCGAGGGCGACACCCTGGTGA |

TABLE 34-continued rAAV Sequences

| SEQ ID NO: | Description | Sequence |
|---|---|---|
| | | ACCGCATCGAGCTGAAGGGCATCGACTTCAAGGAGGACGGCA |
| | | ACATCCTGGGGCACAAGCTGGAGTACAACTACAACAGCCACAA |
| | | CGTCTATATCATGGCCGACAAGCAGAAGAACGGCATCAAGGTG |
| | | AACTTCAAGATCCGCCACAACATCGAGGACGGCAGCGTGCAGC |
| | | TCGCCGACCACTACCAGCAGAACACCCCCATCGGCGACGGCCC |
| | | CGTGCTGCTGCCCGACAACCACTACCTGAGCACCCAGTCCGCC |
| | | CTGAGCAAAGACCCCAACGAGAAGCGCGATCACATGGTCCTGC |
| | | TGGAGTTCGTGACCGCCGCCGGGATCACTCTCGGCATGGACGA |
| | | GCTGTACAAGTAATAATAAAATAAAATCGCTATCCATCGAAGA |
| | | TGGATGTGTGTTGGTTTTTTGTGTGACTGTGGGGTGGAGGGGAC |
| | | AGATAAAAGTACCCAGAACCAGAGCCACATTAACCGGCCCTGG |
| | | GAATATAAGGTGGTCCCAGCTCGGGGACACAGGATCCCTGGAG |
| | | GCAGCAAACATGCTGTCCTGAAGTGGACATAGGGGCCCGGGTT |
| | | GGAGGAAGAAGACTAGCTGAGCTCTCGGACCCCTGGAAGATG |
| | | CCATGACAGGGGCTGGAAGAGCTAGCACAGACTAGAGAGGT |
| | | AAGGGGGGTAGGGGAGCTGCCCAAATGAAAGGAGTGAGAGGT |
| | | GACCCGAATCCACAGGAGAACGGGGTGTCCAGGCAAAGAAAG |
| | | CAAGAGGATGGAGAGGTGGCTAAAGCCAGGGAGACGGGGTAC |
| | | TTTGGGGTTGTCCAGAAAAACGGTGATGATGCAGGCCTACAAG |
| | | AAGGGGAGGCGGGACGCAAGGGAGACATCCGTCGGAGAAGGC |
| | | CATCCTAAGAAACGAGAGATGGCACAGGCCCCAGAAGGAGAA |
| | | GGAAAAGGGAACCCAGCGAGTGAAGACGGCATGGGGTTGGGT |
| | | GAGGGAGGAGAGATGCCCGGAGAGGACCCAGACACGGGGAGG |
| | | ATCCGCTCAGAGGACATCACGTGGTGCAGCGCCGAGAAGGAA |
| | | GTGCTCCGGAAAGAGCATCCTTGGGCAGCAACACAGCAGAGA |
| | | GCAAGGGGAAGAGGGAGTGGAGGAAGACGGAACCTGAAGGA |
| | | GGCGGCGGTAACCACGTGCGGACCGAGGCTGCAGCGTCGTCCT |
| | | CCCTAGGAACCCCTAGTGATGGAGTTGGCCACTCCCTCTCTGCG |
| | | CGCTCGCTCGCTCACTGAGGCCGGGCGACCAAAGGTCGCCCGA |
| | | CGCCCGGGCTTTGCCCGGGCGGCCTCAGTGAGCGAGCGAGCGC |
| | | GCAGCTGCCTGCAGG |
| 1349 | CTX-132 | CCTGCAGGCAGCTGCGCGCTCGCTCGCTCACTGAGGCCGCCCG |
| | | GGCAAAGCCCGGGCGTCGGGCGACCTTTGGTCGCCCGGCCTCA |
| | | GTGAGCGAGCGAGCGCGCAGAGAGGGAGTGGCCAACTCCATC |
| | | ACTAGGGGTTCCTGCGGCCGCACGCGTACTAGTGGCCGCCAGT |
| | | GTGATGGATATCTGCAGAATTCGCCCTTATGGGATCCGAACA |
| | | GAGAGACAGCAGAATATGGGCCAAACAGGATATCTGTGGTAA |
| | | GCAGTTCCTGCCCCGGCTCAGGGCCAAGAACAGTTGGAACAGC |
| | | AGAATATGGGCCAAACAGGATATCTGTGGTAAGCAGTTCCTGC |
| | | CCCGGCTCAGGGCCAAGAACAGATGGTCCCCAGATGCGGTCCC |
| | | GCCCTCAGCAGTTTCTAGAGAACCATCAGATGTTTCCAGGGTG |
| | | CCCCAAGGACCTGAAATGACCCTGTGCCTTATTTGAACTAACC |
| | | AATCAGTTCGCTTCTCGCTTCTGTTCGCGCGCTTCTGCTCCCCG |
| | | AGCTCTATATAAGCAGAGCTCGTTTAGTGAACCGTCAGATCGC |
| | | CTGGAGACGCCATCCACGCTGTTTTGACCTCCATAGAAGACAC |
| | | CGACTCTAGAGGGACCATGCTTCTTTTGGTTACGTCTCTGTTGC |
| | | TTTGCGAACTTCCTCATCCAGCGTTCTTGCTGATCCCCGATATT |
| | | CAGATGACTCAGACCACCAGTAGCTTGTCTGCCTCACTGGGAG |
| | | ACCGAGTAACAATCTCCTGCAGGGCAAGTCAAGACATTAGCAA |
| | | ATACCTCAATTGGTACCAGCAGAAGCCCGACGGAACGGTAAAA |
| | | CTCCTCATCTATCATACGTCAAGGTTGCATTCCGGAGTACCGTC |
| | | ACGATTTTCAGGTTCTGGGAGCGGAACTGACTATTCCTTGACTA |
| | | TTTCAAACCTCGAGCAGGAGGACATTGCGACATATTTTTGTCA |
| | | ACAAGGTAATACCCTCCCTTACACTTTCGGAGGAGGAACCAAA |
| | | CTCGAAATTACCGGGTCCACCAGTGGCTCTGGGAAGCCTGGCA |
| | | GTGGAGAAGGTTCCACTAAAGGCGAGGTGAAGCTCCAGGAGA |
| | | GCGGCCCCGGTCTCGTTGCCCCCAGTCAAAGCCTCTCTGTAACG |
| | | TGCACAGTGAGTGGTGTATCATTGCCTGATTATGGCGTCTCCTG |
| | | GATAAGGCAGCCCCCGCGAAAGGGTCTTGAATGGCTTGGGGTA |
| | | ATATGGGGCTCAGAGACAACGTATTATAACTCCGCTCTCAAAA |
| | | GTCGCTTGACGATAATAAAAGATAACTCCAAGAGTCAAGTTTT |
| | | CCTTAAAATGAACAGTTTGCAGACTGACGATACCGCTATATAT |
| | | TATTGTGCTAAACATTATTACTACGGCGGTAGTTACGCGATGG |
| | | ATTATTGGGGCAGGGGACTTCTGTCACAGTCAGTAGTGCTGC |
| | | TGCCTTTGTCCCGGTATTTCTCCCAGCCAAACCGACCACGACTC |
| | | CCGCCCCGCGCCCTCCGACACCCGCTCCCACCATCGCCTCTCAA |
| | | CCTCTTAGTCTTCGCCCCGAGGCATGCCGACCCGCCGCCGGGG |
| | | GTGCTGTTCATACGAGGGGCTTGGACTTCGCTTGTGATATTTAC |
| | | ATTTGGGCTCCGTTGGCGGGTACGTGCGGCGTCCTTTTGTTGTC |
| | | ACTCGTTATTACTTTGTATTGTAATCACAGGAATCGCTCAAAGC |
| | | GGGAGTAGGTTGTTGCATTCCGATTACATGAATATGACTCCTCGC |
| | | CGGCCTGGGCCGACAAGAAAACATTACCAACCCTATGCCCCCC |
| | | CACGAGACTTCGCTGCGTACAGGTCCCGAGTGAAGTTTTCCCG |
| | | AAGCGCAGACGCTCCGGCATATCAGCAAGGACAGAATCAGCT |
| | | GTATAACGAACTGAATTTGGGACGCCGCGAGGAGTATGACGTG |

TABLE 34-continued rAAV Sequences

| SEQ ID NO: | Description | Sequence |
|---|---|---|
| | | CTTGATAAACGCCGGGGAGAGACCCGGAAATGGGGGGTAAA
CCCCGAAGAAAGAATCCCCAAGAAGGACTCTACAATGAACTCC
AGAAGGATAAGATGGCGGAGGCCTACTCAGAAATAGGTATGA
AGGGCGAACGACGACGGGGAAAAGGTCACGATGGCCTCTACC
AAGGGTTGAGTACGGCAACCAAAGATACGTACGATGCACTGCA
TATGCAGGCCCTGCCTCCCAGAGGAAGCGGAGCTACTAACTTC
AGCCTGCTGAAGCAGGCTGGAGACGTGGAGGAGAACCCTGGA
CCTATGGTGAGCAAGGGCGAGGAGCTGTTCACCGGGGTGGTGC
CCATCCTGGTCGAGCTGGACGGCGACGTAAACGGCCACAAGTT
CAGCGTGTCCGGCGAGGGCGAGGGCGATGCCACCTACGGCAA
GCTGACCCTGAAGTTCATCTGCACCACCGGCAAGCTGCCCGTG
CCCTGGCCCACCCTCGTGACCACCCTGACCTACGGCGTGCAGT
GCTTCAGCCGCTACCCCGACCACATGAAGCAGCACGACTTCTT
CAAGTCCGCCATGCCCGAAGGCTACGTCCAGGAGCGCACCATC
TTCTTCAAGGACGACGGCAACTACAAGACCCGCGCCGAGGTGA
AGTTCGAGGGCGACACCCTGGTGAACCGCATCGAGCTGAAGGG
CATCGACTTCAAGGAGGACGGCAACATCCTGGGGCACAAGCTG
GAGTACAACTACAACAGCCACAACGTCTATATCATGGCCGACA
AGCAGAAGAACGGCATCAAGGTGAACTTCAAGATCCGCCACA
ACATCGAGGACGGCAGCGTGCAGCTCGCCGACCACTACCAGCA
GAACACCCCCATCGGCGACGGCCCCGTGCTGCTGCCCGACAAC
CACTACCTGAGCACCCAGTCCGCCCTGAGCAAAGACCCCAACG
AGAAGCGCGATCACATGGTCCTGCTGGAGTTCGTGACCGCCGC
CGGGATCACTCTCGGCATGGACGAGCTGTACAAGTAATAATAA
AATAAAATCGCTATCCATCGAAGATGGATGTGTGTTGGTTTTTT
GTGTGGGTAACCACGTGCGGACCGAGGCTGCAGCGTCGTCCTC
CCTAGGAACCCCTAGTGATGGAGTTGGCCACTCCCTCTCTGCGC
GCTCGCTCGCTCACTGAGGCCGGGCGACCAAAGGTCGCCCGAC
GCCCGGGCTTTGCCCGGGCGGCCTCAGTGAGCGAGCGAGCGCG
CAGCTGCCTGCAGG |
| 1350 | CTX-133 | CCTGCAGGCAGCTGCGCGCTCGCTCGCTCACTGAGGCCGCCCG
GGCAAAGCCCGGGCGTCGGGCGACCTTTGGTCGCCCGGCCTCA
GTGAGCGAGCGAGCGCGCAGAGAGGGAGTGGCCAACTCCATC
ACTAGGGGTTCCTGCGGCCGCACGCGTGAAGATCCTATTAAAT
AAAAGAATAAGCAGTATTATTAAGTAGCCCTGCATTTCAGGTT
TCCTTGAGTGGCAGGCCAGGCCTGGCCGTGAACGTTCACTGAA
ATCATGGCCTCTTGGCCAAGATTGATAGCTTGTGCCTGTCCCTG
AGTCCCAGTCCATCACGAGCAGCTGGTTTCTAAGATGCTATTTC
CCGTATAAAGCATGAGACCGTGACTTGCCAGCCCCACAGAGCC
CCGCCCTTGTCCATCACTGGCATCTGGACTCCAGCCTGGGTTGG
GGCAAAGAGGGAAATGAGATCATGTCCTAACCCTGATCCTCTT
GTCCCACAGATATCCAGAACCCTGACCCTGCCGTGTACCAGCT
GAGAGACTCTAAATCCAGTGACAAGTCTGTCTGCCTATTCACC
GATTTTGATTCTCAAACAAATGTGTCACAAAGTAAGGATTCTG
ATGTGTATATCACAGACAAAACTGTGCTAGACATGAGGTCTAT
GGACTTCAGGCTCCGGTGCCCGTCAGTGGGCAGAGCGCACATC
GCCCACAGTCCCCGAGAAGTTGGGGGGAGGGGTCGGCAATTG
AACCGGTGCCTAGAGAAGGTGGCGCGGGGTAAACTGGGAAAG
TGATGTCGTGTACTGGCTCCGCCTTTTTCCCGAGGGTGGGGGAG
AACCGTATATAAGTGCAGTAGTCGCCGTGAACGTTCTTTTTCGC
AACGGGTTTGCCGCCAGAACACAGGTAAGTGCCGTGTGTGGTT
CCCGCGGGCCTGGCCTCTTTACGGGTTATGGCCCTTGCGTGCCT
TGAATTACTTCCACTGGCTGCAGTACGTGATTCTTGATCCCGAG
CTTCGGGTTGGAAGTGGGTGGGAGAGTTCGAGGCCTTGCGCTT
AAGGAGCCCCTTCGCCTCGTGCTTGAGTTGAGGCCTGGCCTGG
GCGCTGGGGCCGCCGCGTGCGAATCGGTGGCACCTTCGCGCC
TGTCTCGCTGCTTTCGATAAGTCTCTAGCCATTTAAAATTTTTG
ATGACCTGCTGCGACGCTTTTTTTCTGGCAAGATAGTCTTGTAA
ATGCGGGCCAAGATCTGCACACTGGTATTTCGGTTTTTGGGGCC
GCGGGCGGCGACGGGGCCCGTGCGTCCCAGCGCACATGTTCGG
CGAGGCGGGCCTGCGAGCGCGGCCACCGAGAATCGGACGGG
GGTAGTCTCAAGCTGGCCGGCCTGCTCTGGTGCCTGGCCTCGC
GCCGCCGTGTATCGCCCCGCCCTGGGCGGCAAGGCTGGCCCGG
TCGGCACCAGTTGCGTGAGCGGAAAGATGGCCGCTTCCCGGCC
CTGCTGCAGGGAGCTCAAAATGGAGGACGCGGCGCTCGGGAG
AGCGGGCGGGTGAGTCACCCACACAAAGGAAAAGGGCCTTTC
CGTCCTCAGCCGTCGCTTCATGTGACTCCACGGAGTACCGGGC
GCCGTCCAGGCACCTCGATTAGTTCTCGAGCTTTTGGAGTACGT
CGTCTTTAGGTTGGGGGAGGGGTTTTATGCGATGGAGTTTCCC
CACACTGAGTGGGTGGAGACTGAAGTTAGGCCAGCTTGGCACT
TGATGTAATTCTCCTTGGAATTTGCCCTTTTTGAGTTTGGATCTT
GGTTCATTCTCAAGCCTCAGACAGTGGTTCAAAGTTTTTTTCTT
CCATTTCAGGTGTCGTGACCACCATGCTTCTTTTGGTTACGTCT
CTGTTGCTTTGCGAACTTCCTCATCCAGCGTTCTTGCTGATCCC
CGATATTCAGATGACTCAGACCACCAGTAGCTTGTCTGCCTCAC |

TABLE 34-continued rAAV Sequences

| SEQ ID NO: | Description | Sequence |
|---|---|---|
| | | TGGGAGACCGAGTAACAATCTCCTGCAGGGCAAGTCAAGACAT |
| | | TAGCAAATACCTCAATTGGTACCAGCAGAAGCCCGACGGAACG |
| | | GTAAAACTCCTCATCTATCATACGTCAAGGTTGCATTCCGGAGT |
| | | ACCGTCACGATTTTCAGGTTCTGGGAGCGGAACTGACTATTCCT |
| | | TGACTATTTCAAACCTCGAGCAGGAGGACATTGCGACATATTT |
| | | TTGTCAACAAGGTAATACCCTCCCTTACACTTTCGGAGGAGGA |
| | | ACCAAACTCGAAATTACCGGGTCCACCAGTGGCTCTGGGAAGC |
| | | CTGGCAGTGGAGAAGGTTCCACTAAAGGCGAGGTGAAGCTCCA |
| | | GGAGAGCGGCCCCGGTCTCGTTGCCCCCAGTCAAAGCCTCTCT |
| | | GTAACGTGCACAGTGAGTGGTGTATCATTGCCTGATTATGGCG |
| | | TCTCCTGGATAAGGCAGCCCCCGCGAAAGGGTCTTGAATGGCT |
| | | TGGGGTAATATGGGGCTCAGAGACAACGTATTATAACTCCGCT |
| | | CTCAAAAGTCGCTTGACGATAATAAAAGATAACTCCAAGAGTC |
| | | AAGTTTTCCTTAAAATGAACAGTTTGCAGACTGACGATACCGC |
| | | TATATATTATTGTGCTAAACATTATTACTACGGCGGTAGTTACG |
| | | CGATGGATTATTGGGGCAGGGGACTTCTGTCACAGTCAGTAG |
| | | TGCTGCTGCCTTTGTCCCGGTATTTCTCCCAGCCAAACCGACCA |
| | | CGACTCCCGCCCCGCGCCCTCCGACACCCGCTCCCACCATCGCC |
| | | TCTCAACCTCTTAGTCTTCGCCCCGAGGCATGCCGACCCGCCGC |
| | | CGGGGGTGCTGTTCATACGAGGGGCTTGGACTTCGCTTGTGAT |
| | | ATTTACATTTGGGCTCCGTTGGCGGGTACGTGCGGCGTCCTTTT |
| | | GTTGTCACTCGTTATTACTTTGTATTGTAATCACAGGAATCGCT |
| | | CAAAGCGGAGTAGGTTGTTGCATTCCGATTACATGAATATGAC |
| | | TCCTCGCCGGCCTGGGCCGACAAGAAAACATTACCAACCCTAT |
| | | GCCCCCCCACGAGACTTCGCTGCGTACAGGTCCCGAGTGAAGT |
| | | TTTCCCGAAGCGCAGACGCTCCGGCATATCAGCAAGGACAGAA |
| | | TCAGCTGTATAACGAACTGAATTTGGGACGCCGCGAGGAGTAT |
| | | GACGTGCTTGATAAACGCCGGGGAGAGACCCGGAAATGGGG |
| | | GGTAAACCCCGAAGAAGAATCCCCAAGAAGGACTCTACAAT |
| | | GAACTCCAGAAGGATAAGATGGCGGAGGCCTACTCAGAAATA |
| | | GGTATGAAGGGCGAACGACGACGGGGAAAAGGTCACGATGGC |
| | | CTCTACCAAGGGTTGAGTACGGCAACCAAAGATACGTACGATG |
| | | CACTGCATATGCAGGCCCTGCCTCCCAGAGGAAGCGGAGCTAC |
| | | TAACTTCAGCCTGCTGAAGCAGGCTGGAGACGTGGAGGAGAAC |
| | | CCTGGACCTATGGTGAGCAAGGGCGAGGAGCTGTTCACCGGGG |
| | | TGGTGCCCATCCTGGTCGAGCTGGACGGCGACGTAAACGGCCA |
| | | CAAGTTCAGCGTGTCCGGCGAGGGCGAGGGCGATGCCACCTAC |
| | | GGCAAGCTGACCCTGAAGTTCATCTGCACCACCGGCAAGCTGC |
| | | CCGTGCCCTGGCCCACCCTCGTGACCACCCTGACCTACGGCGT |
| | | GCAGTGCTTCAGCCGCTACCCCGACCACATGAAGCAGCACGAC |
| | | TTCTTCAAGTCCGCCATGCCCGAAGGCTACGTCCAGGAGCGCA |
| | | CCATCTTCTTCAAGGACGACGGCAACTACAAGACCCGCGCCGA |
| | | GGTGAAGTTCGAGGGCGACACCCTGGTGAACCGCATCGAGCTG |
| | | AAGGGCATCGACTTCAAGGAGGACGGCAACATCCTGGGGCAC |
| | | AAGCTGGAGTACAACTACAACAGCCACAACGTCTATATCATGG |
| | | CCGACAAGCAGAAGAACGGCATCAAGGTGAACTTCAAGATCC |
| | | GCCACAACATCGAGGACGGCAGCGTGCAGCTCGCCGACCACTA |
| | | CCAGCAGAACACCCCCATCGGCGACGGCCCCGTGCTGCTGCCC |
| | | GACAACCACTACCTGAGCACCCAGTCCGCCCTGAGCAAAGACC |
| | | CCAACGAGAAGCGCGATCACATGTCCTGCTGGAGTTCGTGAC |
| | | CGCCGCCGGGATCACTCTCGGCATGGACGAGCTGTACAAGTAA |
| | | TAATAAAATAAAATCGCTATCCATCGAAGATGGATGTGTGTTG |
| | | GTTTTTTGTGTGTGGAGCAACAAATCTGACTTTGCATGTGCAAA |
| | | CGCCTTCAACAACAGCATTATTCCAGAAGCACCTTCTTCCCCA |
| | | GCCCAGGTAAGGGCAGCTTTGGTGCCTTCGCAGGCTGTTTCCTT |
| | | GCTTCAGGAATGGCCAGGTTCTGCCCAGAGCTCTGGTCAATGA |
| | | TGTCTAAAACTCCTCTGATTGGTGGTCTCGGCCTTATCCATTGC |
| | | CACCCAAAACCCTCTTTTTACTAAGAAACAGTGAGCCTTGTTCTG |
| | | GCAGTCCAGAGAATGACACGGGAAAAAAGCAGATGAAGAGAA |
| | | GGTGGCAGGAGAGGGCACGTGGCCCAGCCTCAGTCTCTCCAAC |
| | | TGAGTTCCTGCCTGCCTGCCTTTGCTCAGACTGTTTGCCCCTTA |
| | | CTGCTCTTCTAGGCCTCATTCTAAGCCCCTTCTCCAAGTTGCCT |
| | | CTCCTTATTTCTCCCTGTCTGCCAAAAAATCTTTCCCAGCTCACT |
| | | AAGTCAGTCTCACGCAGTCACTCATTAACCCGGTAACCACGTG |
| | | CGGACCGAGGCTGCAGCGTCGTCCTCCCTAGGAACCCCTAGTG |
| | | ATGGAGTTGGCCACTCCCTCTCTGCGCGCTCGCTCGCTCACTGA |
| | | GGCCGGGCGACCAAAGGTCGCCCGACGCCCGGGCTTTGCCCGG |
| | | GCGGCCTCAGTGAGCGAGCGAGCGCGCAGCTGCCTGCAGG |
| 1351 | CTX-134 | CCTGCAGGCAGCTGCGCGCTCGCTCGCTCACTGAGGCCGCCCG |
| | | GGCAAAGCCCGGGCGTCGGGCGACCTTTGGTCGCCCGGCCTCA |
| | | GTGAGCGAGCGAGCGCGCAGAGAGGGAGTGGCCAACTCCATC |
| | | ACTAGGGGTTCCTGCGGCCGCACGCGTGGCTCCGGTGCCCGTC |
| | | AGTGGGCAGAGCGCACATCGCCCACAGTCCCCGAGAAGTTGGG |
| | | GGGAGGGGTCGGCAATTGAACCGGTGCCTAGAGAAGGTGGCG |
| | | CGGGGTAAACTGGGAAAGTGATGTCGTGTACTGGCTCCGCCTT |

TABLE 34-continued rAAV Sequences

SEQ ID NO:Description Sequence

TTTCCCGAGGGTGGGGGAGAACCGTATATAAGTGCAGTAGTCG
CCGTGAACGTTCTTTTTCGCAACGGGTTTGCCGCCAGAACACA
GGTAAGTGCCGTGTGTGGTTCCCGCGGGCCTGGCCTCTTTACGG
GTTATGGCCCTTGCGTGCCTTGAATTACTTCCACTGGCTGCAGT
ACGTGATTCTTGATCCCGAGCTTCGGGTTGGAAGTGGGTGGGA
GAGTTCGAGGCCTTGCGCTTAAGGAGCCCCTTCGCCTCGTGCTT
GAGTTGAGGCCTGGCCTGGGCGCTGGGGCCGCCGCGTGCGAAT
CTGGTGGCACCTTCGCGCCTGTCTCGCTGCTTTCGATAAGTCTC
TAGCCATTTAAAATTTTTGATGACCTGCTGCGACGCTTTTTTCT
GGCAAGATAGTCTTGTAAATGCGGGCCAAGATCTGCACACTGG
TATTTCGGTTTTTGGGGCCGCGGGCGGCGACGGGGCCCGTGCG
TCCCAGCGCACATGTTCGGCGAGGCGGGGCCTGCGAGCGCGGC
CACCGAGAATCGGACGGGGGTAGTCTCAAGCTGGCCGGCCTGC
TCTGGTGCCTGGCCTCGCGCCGCCGTGTATCGCCCCGCCCTGGG
CGGCAAGGCTGGCCCGGTCGGCACCAGTTGCGTGAGCGGAAA
GATGGCCGCTTCCCGGCCCTGCTGCAGGGAGCTCAAAATGGAG
GACGCGGCGCTCGGGAGAGCGGGCGGGTGAGTCACCCACACA
AAGGAAAAGGGCCTTTCCGTCCTCAGCCGTCGCTTCATGTGAC
TCCACGGAGTACCGGGCGCCGTCCAGGCACCTCGATTAGTTCT
CGAGCTTTTGGAGTACGTCGTCTTTAGGTTGGGGGGAGGGGTTT
TATGCGATGGAGTTTCCCCACACTGAGTGGGTGGAGACTGAAG
TTAGGCCAGCTTGGCACTTGATGTAATTCTCCTTGGAATTTGCC
CTTTTTGAGTTTGGATCTTGGTTCATTCTCAAGCCTCAGACAGT
GGTTCAAAGTTTTTTTCTTCCATTTCAGGTGTCGTGACCACCAT
GCTTCTTTTGGTTACGTCTCTGTTGCTTTGCGAACTTCCTCATCC
AGCGTTCTTGCTGATCCCCGATATTCAGATGACTCAGACCACCA
GTAGCTTGTCTGCCTCACTGGGAGACCGAGTAACAATCTCCTG
CAGGGCAAGTCAAGACATTAGCAAATACCTCAATTGGTACCAG
CAGAAGCCCGACGGAACGGTAAAACTCCTCATCTATCATACGT
CAAGGTTGCATTCCGGAGTACCGTCACGATTTTCAGGTTCTGGG
AGCGGAACTGACTATTCCTTGACTATTTCAAACCTCGAGCAGG
AGGACATTGCGACATATTTTTGTCAACAAGGTAATACCCTCCCT
TACACTTTCGGAGGAGGAACCAAACTCGAAATTACCGGGTCCA
CCAGTGGCTCTGGGAAGCCTGGCAGTGGAGAAGGTTCCACTAA
AGGCGAGGTGAAGCTCCAGGAGAGCGGCCCCGGTCTCGTTGCC
CCCAGTCAAAGCCTCTCTGTAACGTGCACAGTGAGTGGTGTAT
CATTGCCTGATTATGGCGTCTCCTGGATAAGGCAGCCCCCGCG
AAAGGGTCTTGAATGGCTTGGGGTAATATGGGGCTCAGAGACA
ACGTATTATAACTCCGCTCTCAAAAGTCGCTTGACGATAATAA
AAGATAACTCCAAGAGTCAAGTTTTCCTTAAAATGAACAGTTT
GCAGACTGACGATACCGCTATATATTATTGTGCTAAACATTATT
ACTACGGCGGTAGTTACGCGATGGATTATTGGGGGCAGGGGAC
TTCTGTCACAGTCAGTAGTGCTGCTGCCTTTGTCCCGGTATTTC
TCCCAGCCAAACCGACCACGACTCCCGCCCCGCGCCCTCCGAC
ACCCGCTCCCACCATCGCCTCTCAACCTCTTAGTCTTCGCCCCG
AGGCATGCCGACCCGCCGCCGGGGGTGCTGTTCATACGAGGGG
CTTGGACTTCGCTTGTGATATTTACATTTGGGCTCCGTTGGCGG
GTACGTGCGGCGTCCTTTTGTTGTCACTCGTTATTACTTTGTATT
GTAATCACAGGAATCGCTCAAAGCGGAGTAGGTTGTTGCATTC
CGATTACATGAATATGACTCCTCGCCGGCCTGGGCCGACAAGA
AAACATTACCAACCCTATGCCCCCCACGAGACTTCGCTGCGT
ACAGGTCCCGAGTGAAGTTTTCCCGAAGCGCAGACGCTCCGGC
ATATCAGCAAGGACAGAATCAGCTGTATAACGAACTGAATTTG
GGACGCCGCGAGGAGTATGACGTGCTTGATAAACGCCGGGGG
AGAGACCCGGAAATGGGGGGTAAACCCCGAAGAAAGAATCCC
CAAGAAGGACTCTACAATGAACTCCAGAAGGATAAGATGGCG
GAGGCCTACTCAGAAATAGGTATGAAGGGCGAACGACGACGG
GGAAAAGGTCACGATGGCCTCTACCAAGGGTTGAGTACGGCAA
CCAAAGATACGTACGATGCACTGCATATGCAGGCCCTGCCTCC
CAGAGGAAGCGGAGCTACTAACTTCAGCCTGCTGAAGCAGGCT
GGAGACGTGGAGGAGAACCCTGGACCTATGGTGAGCAAGGGC
GAGGAGCTGTTCACCGGGGTGGTGCCCATCCTGGTCGAGCTGG
ACGGCGACGTAAACGGCCACAAGTTCAGCGTGTCCGGCGAGG
GCGAGGGCGATGCCACCTACGGCAAGCTGACCCTGAAGTTCAT
CTGCACCACCGGCAAGCTGCCCGTGCCCTGGCCCACCCTCGTG
ACCACCCTGACCTACGGCGTGCAGTGCTTCAGCCGCTACCCCG
ACCACATGAAGCAGCACGACTTCTTCAAGTCCGCCATGCCCGA
AGGCTACGTCCAGGAGCGCACCATCTTCTTCAAGGACGACGGC
AACTACAAGACCCGCGCCGAGGTGAAGTTCGAGGGCGACACC
CTGGTGAACCGCATCGAGCTGAAGGGCATCGACTTCAAGGAGG
ACGGCAACATCCTGGGGCACAAGCTGGAGTACAACTACAACA
GCCACAACGTCTATATCATGGCCGACAAGCAGAAGAACGGCAT
CAAGGTGAACTTCAAGATCCGCCACAACATCGAGGACGGCAGC
GTGCAGCTCGCCGACCACTACCAGCAGAACACCCCCATCGGCG
ACGGCCCCGTGCTGCTGCCCGACAACCACTACCTGAGCACCCA
GTCCGCCCTGAGCAAAGACCCCAACGAGAAGCGCGATCACATG

TABLE 34-continued rAAV Sequences

| SEQ ID NO: | Description | Sequence |
|---|---|---|
| | | GTCCTGCTGGAGTTCGTGACCGCCGCCGGGATCACTCTCGGCA
TGGACGAGCTGTACAAGTAATAATAAAATAAAATCGCTATCCA
TCGAAGATGGATGTGTGTTGGTTTTTTGTGTGGGTAACCACGTG
CGGACCGAGGCTGCAGCGTCGTCCTCCCTAGGAACCCCTAGTG
ATGGAGTTGGCCACTCCCTCTCTGCGCGCTCGCTCGCTCACTGA
GGCCGGGCGACCAAAGGTCGCCCGACGCCCGGGCTTTGCCCGG
GCGGCCTCAGTGAGCGAGCGAGCGCGCAGCTGCCTGCAGG |
| 1352 | CTX-135 | CCTGCAGGCAGCTGCGCGCTCGCTCGCTCACTGAGGCCGCCCG
GGCAAAGCCCGGGCGTCGGGCGACCTTTGGTCGCCCGGCCTCA
GTGAGCGAGCGAGCGCGCAGAGAGGGAGTGGCCAACTCCATC
ACTAGGGGTTCCTGCGGCCGCACGCGTTTTGTAAAGAATATAG
GTAAAAAGTGGCATTTTTTCTTTGGATTTAATTCTTATGGATTT
AAGTCAACATGTATTTTCAAGCCAACAAGTTTTGTTAATAAGAT
GGCTGCACCCTGCTGCTCCATGCCAGATCCACCACACAGAAAG
CAAATGTTCAGTGCATCTCCCTCTTCCTGTCAGAGCTTATAGAG
GAAGGAAGACCCCGCAATGTGGAGGCATATTGTATTACAATTA
CTTTTAATGGCAAAAACTGCAGTTACTTTTGTGCCAACCTACTA
CATGGTCTGGACAGCTAAATGTCATGTATTTTTCATGGCCCCTC
CAGGTATTGTCAGAGTCCTCTTGTTTGGCCTTCTAGGAAGGCTG
TGGGACCCAGCTTTCTTCAACCAGTCCAGGTGGAGGCCTCTGC
CTTGAACGTTTCCAAGTGAGGTAAAACCCGCAGGCCCAGAGGC
CTCTCTACTTCCTGTGTGGGGTTCAGAAACCCTCCTCCCCTCCC
AGCCTCAGGTGCCTGCTTCAGAAAATGGTGAGTCTCTCTCTTAT
AAAGCCCTCCTTTTTCATCCTAGCATTGGGAACAATGGCCCCAG
GGTCCTTATCTCTAGCAGATGTTTTGAAAAAGTCATCTGTTTTG
CTTTTTTTCCAGAAGTAGTAAGTCTGCTGGCCTCCGCCATCTTA
GTAAAGTAACAGTCCCATGAAACAAAGATGCTTCTTTTGGTTA
CGTCTCTGTTGCTTTGCGAACTTCCTCATCCAGCGTTCTTGCTG
ATCCCCGATATTCAGATGACTCAGACCACCAGTAGCTTGTCTGC
CTCACTGGGAGACCGAGTAACAATCTCCTGCAGGGCAAGTCAA
GACATTAGCAAATACCTCAATTGGTACCAGCAGAAGCCCGACG
GAACGGTAAAACTCCTCATCTATCATACGTCAAGGTTGCATTCC
GGAGTACCGTCACGATTTTCAGGTTCTGGGAGCGGAACTGACT
ATTCCTTGACTATTTCAAACCTCGAGCAGGAGGACATTGCGAC
ATATTTTTGTCAACAAGGTAATACCCTCCCTTACACTTTCGGAG
GAGGAACCAAACTCGAAATTACCGGGTCCACCAGTGGCTCTGG
GAAGCCTGGCAGTGGAGAAGGTTCCACTAAAGGCGAGGTGAA
GCTCCAGGAGAGCGGCCCCGGTCTCGTTGCCCCCAGTCAAAGC
CTCTCTGTAACGTGCACAGTGAGTGGTGTATCATTGCCTGATTA
TGGCGTCTCCTGGATAAGGCAGCCCCCGCGAAAGGGTCTTGAA
TGGCTTGGGGTAATATGGGGCTCAGAGACAACGTATTATAACT
CCGCTCTCAAAAGTCGCTTGACGATAATAAAAGATAACTCCAA
GAGTCAAGTTTTCCTTAAAATGAACAGTTTGCAGACTGACGAT
ACCGCTATATATTATTGTGCTAAACATTATTACTACGGCGGTAG
TTACGCGATGGATTATTGGGGGCAGGGGACTTCTGTCACAGTC
AGTAGTGCTGCTGCCTTTGTCCCGGTATTTCTCCCAGCCAAACC
GACCACGACTCCCGCCCCGCGCCCTCCGACACCCGCTCCCACC
ATCGCCTCTCAACCTCTTAGTCTTCGCCCCGAGGCATGCCGACC
CGCCGCCGGGGGTGCTGTTCATACGAGGGGCTTGGACTTCGCT
TGTGATATTTACATTTGGGCTCCGTTGGCGGGTACGTGCGGCGT
CCTTTTGTTGTCACTCGTTATTACTTTGTATTGTAATCACAGGAA
TCGCTCAAAGCGGAGTAGGTTGTTGCATTCCGATTACATGAAT
ATGACTCCTCGCCGGCCTGGGCCGACAAGAAAACATTACCAAC
CCTATGCCCCCCACGAGACTTCGCTGCGTACAGGTCCCGAGT
GAAGTTTTCCCGAAGCGCAGACGCTCCGGCATATCAGCAAGGA
CAGAATCAGCTGTATAACGAACTGAATTTGGGACGCCGCGAGG
AGTATGACGTGCTTGATAAACGCCGGGGAGAGACCCGGAAA
TGGGGGGTAAACCCCGAAGAAAGAATCCCCAAGAAGGACTCT
ACAATGAACTCCAGAAGGATAAGATGGCGGAGGCCTACTCAG
AAATAGGTATGAAGGGCGAACGACGACGGGGAAAAGGTCACG
ATGGCCTCTACCAAGGGTTGAGTACGGCAACCAAAGATACGTA
CGATGCACTGCATATGCAGGCCCTGCCTCCCAGAGGAAGCGGA
GCTACTAACTTCAGCCTGCTGAAGCAGGCTGGAGACGTGGAGG
AGAACCCTGGACCTATGGTGAGCAAGGGCGAGGAGCTGTTCAC
CGGGGTGGTGCCCATCCTGGTCGAGCTGGACGGCGACGTAAAC
GGCCACAAGTTCAGCGTGTCCGGCGAGGGCGAGGGCGATGCC
ACCTACGGCAAGCTGACCCTGAAGTTCATCTGCACCACCGGCA
AGCTGCCCGTGCCCTGGCCCACCCTCGTGACCACCCTGACCTAC
GGCGTGCAGTGCTTCAGCCGCTACCCCGACCACATGAAGCAGC
ACGACTTCTTCAAGTCCGCCATGCCCGAAGGCTACGTCCAGGA
GCGCACCATCTTCTTCAAGGACGACGGCAACTACAAGACCCGC
GCCGAGGTGAAGTTCGAGGGCGACACCCTGGTGAACCGCATCG
AGCTGAAGGGCATCGACTTCAAGGAGGACGGCAACATCCTGG
GGCACAAGCTGGAGTACAACTACAACAGCCACAACGTCTATAT
CATGGCCGACAAGCAGAAGAACGGCATCAAGGTGAACTTCAA |

TABLE 34-continued rAAV Sequences

| SEQ ID NO: | Description | Sequence |
|---|---|---|
| | | GATCCGCCACAACATCGAGGACGGCAGCGTGCAGCTCGCCGAC<br>CACTACCAGCAGAACACCCCCATCGGCGACGGCCCCGTGCTGC<br>TGCCCGACAACCACTACCTGAGCACCCAGTCCGCCCTGAGCAA<br>AGACCCCAACGAGAAGCGCGATCACATGGTCCTGCTGGAGTTC<br>GTGACCGCCGCCGGGATCACTCTCGGCATGGACGAGCTGTACA<br>AGTAATAATAAAATAAAATCGCTATCCATCGAAGATGGATGTG<br>TGTTGGTTTTTTGTGTGGTGAGTAGGATGGAGTGGAAAGGGTG<br>GTGTGTCTCCAGACCGCTGGAAGGCTTACAGCCTTACCTGGCA<br>CTGCCTAGTGGCACCAAGGAGCCTCATTTACCAGATGTAAGGA<br>ACTGTTTGTGCTATGTTAGGGTGAGGGATTAGAGCTGGGGACT<br>AAAGAAAAGATAGGCCACGGGTGCCTGGGAGAGCGTTCGGG<br>GAGCAGGCAAAGAAGAGCAGTTGGGGTGATCATAGCTATTGTG<br>AGCAGAGAGGTCTCGCTACCTCTAAGTACGAGCTCATTCCAAC<br>TTACCCAGCCCTCCAGAACTAACCCAAAAGAGACTGGAAGAGC<br>GAAGCTCCACTCCTTGTTTTGAAGAGACCAGATACTTGCGTCCA<br>AACTCTGCACAGGGCATATATAGCAATTCACTATCTTTGAGAC<br>CATAAAACGCCTCGTAATTTTTAGTCCTTTTCAAGTGACCAACA<br>ACTTTCAGTTTATTTCATTTTTTTGAAGCAAGATGGATTATGAA<br>TTGATAAATAACCAAGAGCATTTCTGTATCTCATATGAGATAA<br>ATAATACCAAAAAAGTTGCCATTTATTGTCAGATACTGTGTA<br>AAGAAAAAATTATTTAGACGTGTTAACTGGTTTAATCCTACTTC<br>TGCCTAGGAAGGAAGGTGTTATATCCTCTTTTTAAAATTCTTTT<br>TAATTTTGACTATATAAACTGATAAGGTAACCACGTGCGGACC<br>GAGGCTGCAGCGTCGTCCTCCCTAGGAACCCCTAGTGATGGAG<br>TTGGCCACTCCCTCTCTGCGCGCTCGCTCGCTCACTGAGGCCGG<br>GCGACCAAAGGTCGCCCGACGCCCGGGCTTTGCCCGGGCGCC<br>TCAGTGAGCGAGCGAGCGCGCAGCTGCCTGCAGG |
| 1353 | CTX-136 | CCTGCAGGCAGCTGCGCGCTCGCTCGCTCACTGAGGCCGCCCG<br>GGCAAAGCCCGGGCGTCGGGCGACCTTTGGTCGCCCGGCCTCA<br>GTGAGCGAGCGAGCGCGCAGAGAGGGAGTGGCCAACTCCATC<br>ACTAGGGGTTCCTGCGGCCGCACGCGTATGCTTCTTTTGGTTAC<br>GTCTCTGTTGCTTTGCGAACTTCCTCATCCAGCGTTCTTGCTGAT<br>CCCCGATATTCAGATGACTCAGACCACCAGTAGCTTGTCTGCCT<br>CACTGGGAGACCGAGTAACAATCTCCTGCAGGGCAAGTCAAGA<br>CATTAGCAAATACCTCAATTGGTACCAGCAGAAGCCCGACGGA<br>ACGGTAAAACTCCTCATCTATCATACGTCAAGGTTGCATTCCGG<br>AGTACCGTCACGATTTTCAGGTTCTGGGAGCGGAACTGACTAT<br>TCCTTGACTATTTCAAACCTCGAGCAGGAGGACATTGCGACAT<br>ATTTTTGTCAACAAGGTAATACCCTCCCTTACACTTTCGGAGGA<br>GGAACCAAACTCGAAATTACCGGGTCCACCAGTGGCTCTGGGA<br>AGCCTGGCAGTGGAGAAGGTTCCACTAAAGGCGAGGTGAAGC<br>TCCAGGAGAGCGGCCCCGGTCTCGTTGCCCCCAGTCAAAGCCT<br>CTCTGTAACGTGCACAGTGAGTGGTGTATCATTGCCTGATTATG<br>GCGTCTCCTGGATAAGGCAGCCCCCGCGAAAGGGTCTTGAATG<br>GCTTGGGGTAATATGGGGCTCAGAGACAACGTATTATAACTCC<br>GCTCTCAAAAGTCGCTTGACGATAATAAAAGATAACTCCAAGA<br>GTCAAGTTTTCCTTAAAATGAACAGTTTGCAGACTGACGATAC<br>CGCTATATATTATTGTGCTAAACATTATTACTACGGCGGTAGTT<br>ACGCGATGGATTATTGGGGGCAGGGGACTTCTGTCACAGTCAG<br>TAGTGCTGCTGCCTTTGTCCCGGTATTTCTCCCAGCCAAACCGA<br>CCACGACTCCCGCCCCGCGCCTCCGACACCCGCTCCCACCATC<br>GCCTCTCAACCTCTTAGTCTTCGCCCCGAGGCATGCCGACCCGC<br>CGCCGGGGGTGCTGTTCATACGAGGGGCTTGGACTTCGCTTGT<br>GATATTTACATTTGGGCTCCGTTGGCGGGTACGTGCGGCGTCCT<br>TTTGTTGTCACTCGTTATTACTTTGTATTGTAATCACAGGAATC<br>GCTCAAAGCGGAGTAGGTTGTTGCATTCCGATTACATGAATAT<br>GACTCCTCGCCGGCCTGGGCCGACAAGAAAACATTACCAACCC<br>TATGCCCCCCACGAGACTTCGCTGCGTACAGGTCCCGAGTGA<br>AGTTTTCCCGAAGCGCAGACGCTCCGGCATATCAGCAAGGACA<br>GAATCAGCTGTATAACGAACTGAATTTGGGACGCCGCGAGGAG<br>TATGACGTGCTTGATAAACGCCGGGGAGAGACCCGGAAATG<br>GGGGGTAAACCCCGAAGAAAGAATCCCCAAGAAGGACTCTAC<br>AATGAACTCCAGAAGGATAAGATGCGGAGGCCTACTCAGAA<br>ATAGGTATGAAGGGCGAACGACGACGGGGAAAAGGTCACGAT<br>GGCCTCTACCAAGGGTTGAGTACGGCAACCAAAGATACGTACG<br>ATGCACTGCATATGCAGGCCCTGCCTCCCAGAGGAAGCGGAGC<br>TACTAACTTCAGCCTGCTGAAGCAGGCTGGAGACGTGGAGGAG<br>AACCCTGGACCTATGGTGAGCAAGGGCGAGGAGCTGTTCACCG<br>GGGTGGTGCCCATCCTGGTCGAGCTGGACGGCGACGTAAACGG<br>CCACAAGTTCAGCGTGTCCGGCGAGGGCGAGGGCGATGCCACC<br>TACGGCAAGCTGACCCTGAAGTTCATCTGCACCACCGGCAAGC<br>TGCCCGTGCCCTGGCCCACCCTCGTGACCACCCTGACCTACGGC<br>GTGCAGTGCTTCAGCCGCTACCCCGACCACATGAAGCAGCACG<br>ACTTCTTCAAGTCCGCCATGCCCGAAGGCTACGTCCAGGAGCG<br>CACCATCTTCTTCAAGGACGACGGCAACTACAAGACCCGCGCC |

TABLE 34-continued rAAV Sequences

| SEQ ID NO: | Description | Sequence |
|---|---|---|
| | | GAGGTGAAGTTCGAGGGCGACACCCTGGTGAACCGCATCGAGC
TGAAGGGCATCGACTTCAAGGAGGACGGCAACATCCTGGGGC
ACAAGCTGGAGTACAACTACAACAGCCACAACGTCTATATCAT
GGCCGACAAGCAGAAGAACGGCATCAAGGTGAACTTCAAGAT
CCGCCACAACATCGAGGACGGCAGCGTGCAGCTCGCCGACCAC
TACCAGCAGAACACCCCCATCGGCGACGGCCCCGTGCTGCTGC
CCGACAACCACTACCTGAGCACCCAGTCCGCCCTGAGCAAAGA
CCCCAACGAGAAGCGCGATCACATGGTCCTGCTGGAGTTCGTG
ACCGCCGCGGGATCACTCTCGGCATGGACGAGCTGTACAAGT
AATAATAAAATAAAATCGCTATCCATCGAAGATGGATGTGTGT
TGGTTTTTTGTGTGGGTAACCACGTGCGGACCGAGGCTGCAGC
GTCGTCCTCCCTAGGAACCCCTAGTGATGGAGTTGGCCACTCCC
TCTCTGCGCGCTCGCTCGCTCACTGAGGCCGGGCGACCAAAGG
TCGCCCGACGCCCGGGCTTTGCCCGGGCGGCCTCAGTGAGCGA
GCGAGCGCGCAGCTGCCTGCAGG |
| 1354 | CTX-138 | CCTGCAGGCAGCTGCGCGCTCGCTCGCTCACTGAGGCCGCCCG
GGCGTCGGGCGACCTTTGGTCGCCCGGCCTCAGTGAGCGAGCG
AGCGCGCAGAGAGGGAGTGGCCAACTCCATCACTAGGGGTTCC
TGCGGCCGCACGCGTGAGATGTAAGGAGCTGCTGTGACTTGCT
CAAGGCCTTATATCGAGTAAACGGTAGTGCTGGGGCTTAGACG
CAGGTGTTCTGATTTATAGTTCAAAACCTCTATCAATGAGAGA
GCAATCTCCTGGTAATGTGATAGATTTCCCAACTTAATGCCAAC
ATACCATAAACCTCCCATTCTGCTAATGCCCAGCCTAAGTTGGG
GAGACCACTCCAGATTCCAAGATGTACAGTTTGCTTTGCTGGG
CCTTTTTTCCCATGCCTGCCTTTACTCTGCCAGAGTTATATTGCTG
GGGTTTTTGAAGAAGATCCTATTAAATAAAAGAATAAGCAGTAT
TATTAAGTAGCCCTGCATTTCAGGTTTCCTTGAGTGGCAGGCCA
GGCCTGGCCGTGAACGTTCACTGAAATCATGGCCTCTTGGCCA
AGATTGATAGCTTGTGCCTGTCCCTGAGTCCCAGTCCATCACGA
GCAGCTGGTTTCTAAGATGCTATTTCCCGTATAAAGCATGAGA
CCGTGACTTGCCAGCCCCACAGAGCCCCGCCCTTGTCCATCACT
GGCATCTGGACTCCAGCCTGGGTTGGGGCAAAGAGGGAAATG
AGATCATGTCCTAACCCTGATCCTCTTGTCCCACAGATATCCAG
AACCCTGACCCTGCCGTGTACCAGCTGAGAGACTCTAAATCCA
GTGACAAGTCTGTCTGCCTATTCACCGATTTTGATTCTCAAACA
AATGTGTCACAAAGTAAGGATTCTGATGTGTATATCACAGACA
AAACTGTGCTAGACATGAGGTCTATGGACTTCAGGCTCCGGTG
CCCGTCAGTGGGCAGAGCGCACATCGCCCACAGTCCCCGAGAA
GTTGGGGGGAGGGGTCGGCAATTGAACCGGTGCCTAGAGAAG
GTGGCGCGGGGTAAACTGGGAAAGTGATGTCGTGTACTGGCTC
CGCCTTTTTCCCGAGGGTGGGGGAGAACCGTATATAAGTGCAG
TAGTCGCCGTGAACGTTCTTTTTCGCAACGGGTTTGCCGCCAGA
ACACAGGTAAGTGCCGTGTGTGGTTCCCGCGGGCCTGGCCTCT
TTACGGGTTATGGCCCTTGCGTGCCTTGAATTACTTCCACTGGC
TGCAGTACGTGATTCTTGATCCCGAGCTTCGGGTTGGAAGTGG
GTGGGAGAGTTCGAGGCCTTGCGCTTAAGGAGCCCCTTCGCCT
CGTGCTTGAGTTGAGGCCTGGCCTGGGCGCTGGGGCCGCCGCG
TGCGAATCTGGTGGCACCTTCGCGCCTGTCTCGCTGCTTTCGAT
AAGTCTCTAGCCATTTAAAATTTTTGATGACCTGCTGCGACGCT
TTTTTTCTGGCAAGATAGTCTTGTAAATGCGGGCCAAGATCTGC
ACACTGGTATTTCGGTTTTTGGGGCCGCGGGCGGCGACGGGGC
CCGTGCGTCCCAGCGCACATGTTCGGCGAGGCGGGGCCTGCGA
GCGCGGCCACCGAGAATCGGACGGGGGTAGTCTCAAGCTGGCC
GGCCTGCTCTGGTGCCTGGCCTCGCGCCGCCGTGTATCGCCCCG
CCCTGGGCGGCAAGGCTGGCCCGGTCGGCACCAGTTGCGTGAG
CGGAAAGATGGCCGCTTCCCGGCCCTGCTGCAGGGAGCTCAAA
ATGGAGGACGCGCGCTCGGGAGAGCGGGCGGGTGAGTCACC
CACACAAAGGAAAAGGGCCTTTCCGTCCTCAGCCGTCGCTTCA
TGTGACTCCACGGAGTACCGGGCGCCGTCCAGGCACCTCGATT
AGTTCTCGAGCTTTTGGAGTACGTCGTCTTTAGGTTGGGGGGAG
GGGTTTTATGCGATGGAGTTTCCCCACACTGAGTGGGTGGAGA
CTGAAGTTAGGCCAGCTTGGCACTTGATGTAATTCTCCTTGGAA
TTTGCCCTTTTTGAGTTTGGATCTTGGTTCATTCTCAAGCCTCAG
ACAGTGGTTCAAAGTTTTTTTCTTCCATTTCAGGTGTCGTGACC
ACCATGCTTCTTTTGGTTACGTCTCTGTTGCTTTGCGAACTTCCT
CATCCAGCGTTCTTGCTGATCCCCGATATTCAGATGACTCAGAC
CACCAGTAGCTTGTCTGCCTCACTGGGAGACCGAGTAACAATC
TCCTGCAGGGCAAGTCAAGACATTAGCAAATACCTCAATTGGT
ACCAGCAGAAGCCCGACGGAACGGTAAAACTCCTCATCTATCA
TACGTCAAGGTTGCATTCCGGAGTACCGTCACGATTTTCAGGTT
CTGGGAGCGGAACTGACTATTCCTTGACTATTTCAAACCTCGA
GCAGGAGGACATTGCGACATATTTTTGTCAACAAGGTAATACC
CTCCCTTACACTTTCGGAGGAGGAACCAAACTCGAAATTACCG
GGTCCACCAGTGGCTCTGGGAAGCCTGGCAGTGGAGAAGGTTC
CACTAAAGGCGAGGTGAAGCTCCAGGAGAGCGGCCCCGGTCTC |

TABLE 34-continued rAAV Sequences

| SEQ ID NO: | Description | Sequence |
|---|---|---|
| | | GTTGCCCCCAGTCAAAGCCTCTCTGTAACGTGCACAGTGAGTG
GTGTATCATTGCCTGATTATGGCGTCTCCTGGATAAGGCAGCCC
CCGCGAAAGGGTCTTGAATGGCTTGGGGTAATATGGGGCTCAG
AGACAACGTATTATAACTCCGCTCTCAAAAGTCGCTTGACGAT
AATAAAAGATAACTCCAAGAGTCAAGTTTTCCTTAAAATGAAC
AGTTTGCAGACTGACGATACCGCTATATATTATTGTGCTAAACA
TTATTACTACGGCGGTAGTTACGCGATGGATTATTGGGGGCAG
GGGACTTCTGTCACAGTCAGTAGTGCTGCTGCCTTTGTCCCGGT
ATTTCTCCCAGCCAAACCGACCACGACTCCCGCCCCGCGCCCTC
CGACACCCGCTCCCACCATCGCCTCTCAACCTCTTAGTCTTCGC
CCCGAGGCATGCCGACCCGCCGCCGGGGGTGCTGTTCATACGA
GGGGCTTGGACTTCGCTTGTGATATTTACATTTGGGCTCCGTTG
GCGGGTACGTGCGGCGTCCTTTTGTTGTCACTCGTTATTACTTT
GTATTGTAATCACAGGAATCGCTCAAAGCGGAGTAGGTTGTTG
CATTCCGATTACATGAATATGACTCCTCGCCGGCCTGGGCCGA
CAAGAAAACATTACCAACCCTATGCCCCCCCACGAGACTTCGC
TGCCGTACAGGTCCCGAGTGAAGTTTTCCCGAAGCGCAGACGCT
CCGGCATATCAGCAAGGACAGAATCAGCTGTATAACGAACTGA
ATTTGGGACGCCGCGAGGAGTATGACGTGCTTGATAAACGCCG
GGGGAGAGACCCGGAAATGGGGGTAAACCCCGAAGAAAGAA
TCCCCAAGAAGGACTCTACAATGAACTCCAGAAGGATAAGATG
GCGGAGGCCTACTCAGAAATAGGTATGAAGGGCGAACGACGA
CGGGGAAAAGGTCACGATGGCCTCTACCAAGGGTTGAGTACGG
CAACCAAAGATACGTACGATGCACTGCATATGCAGGCCCTGCC
TCCCAGATAATAATAAAATCGCTATCCATCGAAGATGGATGTG
TGTTGGTTTTTTGTGTGGAGCAACAAATCTGACTTTGCATGT
GCAAACGCCTTCAACAACAGCATTATTCCAGAAGACACCTTCT
TCCCCAGCCCAGGTAAGGGCAGCTTTGGTGCCTTCGCAGGCTG
TTTCCTTGCTTCAGGAATGGCCAGGTTCTGCCCAGAGCTCTGGT
CAATGATGTCTAAAACTCCTCTGATTGGTGGTCTCGGCCTTATC
CATTGCCACCAAAACCCTCTTTTTACTAAGAAACAGTGAGCCTT
GTTCTGGCAGTCCAGAGAATGACACGGGAAAAAAGCAGATGA
AGAGAAGGTGGCAGGAGAGGGCACGTGGCCCAGCCTCAGTCT
CTCCAACTGAGTTCCTGCCTGCCTGCCTTTGCTCAGACTGTTTG
CCCCTTACTGCTCTTCTAGGCCTCATTCTAAGCCCCTTCTCCAA
GTTGCCTCTCCTTATTTCTCCCTGTCTGCCAAAAAATCTTTCCCA
GCTCACTAAGTCAGTCTCACGCAGTCACTCATTAACCCACCAAT
CACTGATTGTGCCGGCACATGAATGCACCAGGTGTTGAAGTGG
AGGAATTAAAAAGTCAGATGAGGGGTGTGCCCAGAGGAAGCA
CCATTCTAGTTGGGGGAGCCCATCTGTCAGCTGGGAAAAGTCC
AAATAACTTCAGATTGGAATGTGTTTTAACTCAGGGTTGAGAA
AACAGCTACCTTCAGGACAAAAGTCAGGGAAGGGCTCTCTGAA
GAAATGCTACTTGAAGATACCAGCCCTACCAAGGGCAGGGAG
AGGACCCTATAGAGGCCTGGGACAGGAGCTCAATGAGAAAGG
TAACCACGTGCGGACCGAGGCTGCAGCGTCGTCCTCCCTAGGA
ACCCCTAGTGATGGAGTTGGCCACTCCCTCTCTGCGCGCTCGCT
CGCTCACTGAGGCCGGGCGACCAAAGGTCGCCCGACGCCCGGG
CTTTGCCCGGGCGGCCTCAGTGAGCGAGCGAGCGCGCAGCTGC
CTGCAGG |
| 1355 | CTX-139 | CCTGCAGGCAGCTGCGCGCTCGCTCGCTCACTGAGGCCGCCCG
GGCGTCGGGCGACCTTTGGTCGCCCGGCCTCAGTGAGCGAGCG
AGCGCGCAGAGAGGGAGTGGCCAACTCCATCACTAGGGGTTCC
TGCCGGCCGCACGCGTGAGATGTAAGGAGCTGCTGTGACTTGCT
CAAGGCCTTATATCGAGTAAACGGTAGTGCTGGGGCTTAGACG
CAGGTGTTCTGATTTATAGTTCAAAACCTCTATCAATGAGAGA
GCAATCTCCTGGTAATGTGATAGATTTCCCAACTTAATGCCAAC
ATACCATAAACCTCCCATTCTGCTAATGCCCAGCCTAAGTTGGG
GAGACCACTCCAGATTCCAAGATGTACAGTTTGCTTTGCTGGG
CCTTTTTCCCATGCCTGCCTTTACTCTGCCAGAGTTATATTGCTG
GGGTTTTGAAGAAGATCCTATTAAATAAAAGAATAAGCAGTAT
TATTAAGTAGCCCTGCATTTCAGGTTTCCTTGAGTGGCAGGCCA
GGCCTGGCCGTGAACGTTCACTGAAATCATGGCCTCTTGGCCA
AGATTGATAGCTTGTGCCTGTCCCTGAGTCCCAGTCCATCACGA
GCAGCTGGTTTCTAAGATGCTATTTCCCGTATAAAGCATGAGA
CCGTGACTTGCCAGCCCCACAGAGCCCCGCCCTTGTCCATCACT
GGCATCTGGACTCCAGCCTGGGTTGGGGCAAAGAGGGAAATG
AGATCATGTCCTAACCCTGATCCTCTTGTCCCACAGATATCCAG
AACCCTGACCCTGCCGTGTACCAGCTGAGAGACTCTAAATCGG
CTCCGGTGCCCGTCAGTGGGCAGAGCGCACATCGCCCACAGTC
CCCGAGAAGTTGGGGGGAGGGGTCGGCAATTGAACCGGTGCCT
AGAGAAGGTGGCGCGGGGTAAACTGGGAAAGTGATGTCGTGT
ACTGGCTCCGCCTTTTTCCCGAGGGTGGGGGAGAACCGTATAT
AAGTGCAGTAGTCGCCGTGAACGTTCTTTTTCGCAACGGGTTTG
CCGCCAGAACACAGGTAAGTGCCGTGTGTGGTTCCCGCGGGCC
TGGCCTCTTTACGGGTTATGGCCCTTGCGTGCCTTGAATTACTT |

TABLE 34-continued rAAV Sequences

SEQ ID NO:Description Sequence

```
CCACTGGCTGCAGTACGTGATTCTTGATCCCGAGCTTCGGGTTG
GAAGTGGGTGGGAGAGTTCGAGGCCTTGCGCTTAAGGAGCCCC
TTCGCCTCGTGCTTGAGTTGAGGCCTGGCCTGGGCGCTGGGGC
CGCCGCGTGCGAATCTGGTGGCACCTTCGCGCCTGTCTCGCTGC
TTTCGATAAGTCTCTAGCCATTTAAAATTTTTGATGACCTGCTG
CGACGCTTTTTTTCTGGCAAGATAGTCTTGTAAATGCGGGCCAA
GATCTGCACACTGGTATTTCGGTTTTTGGGGCCGCGGGCGGCG
ACGGGGCCCGTGCGTCCCAGCGCACATGTTCGGCGAGGCGGGG
CCTGCGAGCGCGGCCACCGAGAATCGGACGGGGGTAGTCTCAA
GCTGGCCGGCCTGCTCTGGTGCCTGGCCTCGCGCCGCCGTGTAT
CGCCCCGCCCTGGGCGGCAAGGCTGGCCCGGTCGGCACCAGTT
GCGTGAGCGGAAAGATGGCCGCTTCCCGGCCCTGCTGCAGGGA
GCTCAAAATGGAGGACGCGGCGCTCGGGAGAGCGGGCGGGTG
AGTCACCCACACAAAGGAAAAGGGCCTTTCCGTCCTCAGCCGT
CGCTTCATGTGACTCCACGGAGTACCGGGCGCCGTCCAGGCAC
CTCGATTAGTTCTCGAGCTTTTGGAGTACGTCGTCTTTAGGTTG
GGGGGAGGGGTTTTATGCGATGGAGTTTCCCCACACTGAGTGG
GTGGAGACTGAAGTTAGGCCAGCTTGGCACTTGATGTAATTCT
CCTTGGAATTTGCCCTTTTTGAGTTTGGATCTTGGTTCATTCTCA
AGCCTCAGACAGTGGTTCAAAGTTTTTTTCTTCCATTTCAGGTG
TCGTGACCACCATGCTTCTTTTGGTTACGTCTCTGTTGCTTTGCG
AACTTCCTCATCCAGCGTTCTTGCTGATCCCCGATATTCAGATG
ACTCAGACCACCAGTAGCTTGTCTGCCTCACTGGGAGACCGAG
TAACAATCTCCTGCAGGGCAAGTCAAGACATTAGCAAATACCT
CAATTGGTACCAGCAGAAGCCCGACGGAACGGTAAAACTCCTC
ATCTATCATACGTCAAGGTTGCATTCCGGAGTACCGTCACGATT
TCAGGTTCTGGGAGCGGAACTGACTATTCCTTGACTATTTCAA
ACCTCGAGCAGGAGGACATTGCGACATATTTTTGTCAACAAGG
TAATACCCTCCCTTACACTTTCGGAGGAGGAACCAAACTCGAA
ATTACCGGGTCCACCAGTGGCTCTGGGAAGCCTGGCAGTGGAG
AAGGTTCCACTAAAGGCGAGGTGAAGCTCCAGGAGAGCGGCC
CCGGTCTCGTTGCCCCCAGTCAAAGCCTCTCTGTAACGTGCACA
GTGAGTGGTGTATCATTGCCTGATTATGGCGTCTCCTGGATAAG
GCAGCCCCGCGAAAGGGTCTTGAATGGCTTGGGGTAATATGG
GGCTCAGAGACAACGTATTATAACTCCGCTCTCAAAAGTCGCT
TGACGATAATAAAAGATAACTCCAAGAGTCAAGTTTTCCTTAA
AATGAACAGTTTGCAGACTGACGATACCGCTATATATTATTGT
GCTAAACATTATTACTACGGCGGTAGTTACGCGATGGATTATT
GGGGGCAGGGGACTTCTGTCACAGTCAGTAGTGCTGCTGCCTT
TGTCCCGGTATTTCTCCCAGCCAAACCGACCACGACTCCCGCCC
CGCGCCCTCCGACACCCGCTCCCACCATCGCCTCTCAACCTCTT
AGTCTTCGCCCCGAGGCATGCCGACCCGCCGCCGGGGGTGCTG
TTCATACGAGGGGCTTGGACTTCGCTTGTGATATTTACATTTGG
GCTCCGTTGGCGGGTACGTGCGGCGTCCTTTTGTTGTCACTCGT
TATTACTTTGTATTGTAATCACAGGAATCGCTCAAAGCGGAGT
AGGTTGTTGCATTCCGATTACATGAATATGACTCCTCGCCGGCC
TGGGCCGACAAGAAAACATTACCAACCCTATGCCCCCCCACGA
GACTTCGCTGCGTACAGGTCCCGAGTGAAGTTTTCCCGAAGCG
CAGACGCTCCGGCATATCAGCAAGGACAGAATCAGCTGTATAA
CGAACTGAATTTGGGACGCCGCGAGGAGTATGACGTGCTTGAT
AAACGCCGGGGAGAGACCCGGAAATGGGGGGTAAACCCCGA
AGAAAGAATCCCCAAGAAGGACTCTACAATGAACTCCAGAAG
GATAAGATGGCGGAGGCCTACTCAGAAATAGGTATGAAGGGC
GAACGACGACGGGGAAAAGGTCACGATGGCCTCTACCAAGGG
TTGAGTACGGCAACCAAAGATACGTACGATGCACTGCATATGC
AGGCCCTGCCTCCCAGATAATAATAAAATCGCTATCCATCGAA
GATGGATGTGTGTTGGTTTTTTGTGTGTGGAGCAACAAATCTGA
CTTTGCATGTGCAAACGCCTTCAACAACAGCATTATTCCAGAA
GACACCTTCTTCCCCAGCCCAGGTAAGGGCAGCTTTGGTGCCTT
CGCAGGCTGTTTCCTTGCTTCAGGAATGGCCAGGTTCTGCCCAG
AGCTCTGGTCAATGATGTCTAAAACTCCTCTGATTGGTGGTCTC
GGCCTTATCCATTGCCACCAAAACCCTCTTTTTACTAAGAAACA
GTGAGCCTTGTTCTGGCAGTCCAGAGAATGACACGGGAAAAAA
GCAGATGAAGAGAAGGTGGCAGGAGAGGGCACGTGGCCCAGC
CTCAGTCTCTCCAACTGAGTTCCTGCCTGCCTGCCTTTGCTCAG
ACTGTTTGCCCCTTACTGCTCTTCTAGGCCTCATTCTAAGCCCCT
TCTCCAAGTTGCCTCTCCTTATTTCTCCCTGTCTGCCAAAAAAT
CTTTCCCAGCTCACTAAGTCAGTCTCACGCAGTCACTCATTAAC
CCACCAATCACTGATTGTGCCGGCACATGAATGCACCAGGTGT
TGAAGTGGAGGAATTAAAAAGTCAGATGAGGGGTGTGCCCAG
AGGAAGCACCATTCTAGTTGGGGGAGCCCATCTGTCAGCTGGG
AAAAGTCCAAATAACTTCAGATTGGAATGTGTTTTAACTCAGG
GTTGAGAAAACAGCTACCTTCAGGACAAAAGTCAGGGAAGGG
CTCTCTGAAGAAATGCTACTTGAAGATACCAGCCCTACCAAGG
GCAGGGAGAGGACCCTATAGAGGCCTGGGACAGGAGCTCAAT
GAGAAAGGTAACCACGTGCGGACCGAGGCTGCAGCGTCGTCCT
```

TABLE 34-continued rAAV Sequences

| SEQ ID NO: | Description | Sequence |
|---|---|---|
| | | CCCTAGGAACCCCTAGTGATGGAGTTGGCCACTCCCTCTCTGCG<br>CGCTCGCTCGCTCACTGAGGCCGGGCGACCAAAGGTCGCCCGA<br>CGCCCGGGCTTTGCCCGGGCGGCCTCAGTGAGCGAGCGAGCGC<br>GCAGCTGCCTGCAGG |
| 1356 | CTX-140 | TTGGCCACTCCCTCTCTGCGCGCTCGCTCGCTCACTGAGGCCGG<br>GCGACCAAAGGTCGCCCGACGCCCGGGCTTTGCCCGGGCGGCC<br>TCAGTGAGCGAGCGAGCGCGCAGAGAGGGAGTGGCCAACTCC<br>ATCACTAGGGGTTCCTGCGGCCGCACGCGTAATCCTCCGGCAA<br>ACCTCTGTTTCCTCCTCAAAAGGCAGGAGGTCGGAAAGAATAA<br>ACAATGAGAGTCACATTAAAAACACAAAATCCTACGGAAATAC<br>TGAAGAATGAGTCTCAGCACTAAGGAAAAGCCTCCAGCAGCTC<br>CTGCTTTCTGAGGGTGAAGGATAGACGCTGTGGCTCTGCATGA<br>CTCACTAGCACTCTATCACGGCCATATTCTGGCAGGGTCAGTG<br>GCTCCAACTAACATTTGTTTGGTACTTTACAGTTTATTAAATAG<br>ATGTTTATATGGAGAAGCTCTCATTTCTTTCTCAGAAGAGCCTG<br>GCTAGGAAGGTGGATGAGGCACCATATTCATTTTGCAGGTGAA<br>ATTCCTGAGATGTAAGGAGCTGCTGTGACTTGCTCAAGGCCTT<br>ATATCGAGTAAACGGTAGTGCTGGGGCTTAGACGCAGGTGTTC<br>TGATTTATAGTTCAAAACCTCTATCAATGAGAGAGCAATCTCCT<br>GGTAATGTGATAGATTTCCCAACTTAATGCCAACATACCATAA<br>ACCTCCCATTCTGCTAATGCCCAGCCTAAGTTGGGGAGACCAC<br>TCCAGATTCCAAGATGTACAGTTTGCTTTGCTGGGCCTTTTTCC<br>CATGCCTGCCTTTACTCTGCCAGAGTTATATTGCTGGGGTTTTG<br>AAGAAGATCCTATTAAATAAAAGAATAAGCAGTATTATTAAGT<br>AGCCCTGCATTTCAGGTTTCCTTGAGTGGCAGGCCAGGCCTGG<br>CCGTGAACGTTCACTGAAATCATGGCCTCTTGGCCAAGATTGA<br>TAGCTTGTGCCTGTCCCTGAGTCCCAGTCCATCACGAGCAGCTG<br>GTTTCTAAGATGCTATTTCCCGTATAAAGCATGAGACCGTGACT<br>TGCCAGCCCCACAGAGCCCCGCCCTTGTCCATCACTGGCATCTG<br>GACTCCAGCCTGGGTTGGGGCAAAGAGGGAAATGAGATCATGT<br>CCTAACCCTGATCCTCTTGTCCCACAGATATCGGAAGCGGAGC<br>TACTAACTTCAGCCTGCTGAAGCAGGCTGGAGACGTGGAGGAG<br>AACCCTGGACCCATGCTTCTTTTGGTTACGTCTCTGTTGCTTTGC<br>GAACTTCCTCATCCAGCGTTCTTGCTGATCCCCGATATTCAGAT<br>GACTCAGACCACCAGTAGCTTGTCTGCCTCACTGGGAGACCGA<br>GTAACAATCTCCTGCAGGGCAAGTCAAGACATTAGCAAATACC<br>TCAATTGGTACCAGCAGAAGCCCGACGGAACGGTAAAACTCCT<br>CATCTATCATACGTCAAGGTTGCATTCCGGAGTACCGTCACGAT<br>TTTCAGGTTCTGGGAGCGGAACTGACTATTCCTTGACTATTTCA<br>AACCTCGAGCAGGAGGACATTGCGACATATTTTTGTCAACAAG<br>GTAATACCCTCCCTTACACTTTCGGAGGAGGAACCAAACTCGA<br>AATTACCGGGTCCACCAGTGGCTCTGGGAAGCCTGGCAGTGGA<br>GAAGGTTCCACTAAAGGCGAGGTGAAGCTCCAGGAGAGCGGC<br>CCCGGTCTCGTTGCCCCCAGTCAAAGCCTCTCTGTAACGTGCAC<br>AGTGAGTGGTGTATCATTGCCTGATTATGGCGTCTCCTGGATAA<br>GGCAGCCCCCGCGAAAGGGTCTTGAATGGCTTGGGGTAATATG<br>GGGCTCAGAGACAACGTATTATAACTCCGCTCTCAAAAGTCGC<br>TTGACGATAATAAAAGATAACTCCAAGAGTCAAGTTTTCCTTA<br>AAATGAACAGTTTGCAGACTGACGATACCGCTATATATTATTG<br>TGCTAAACATTATTACTACGGCGGTAGTTACGCGATGGATTATT<br>GGGGGCAGGGGACTTCTGTCACAGTCAGTAGTGCTGCTGCCTTT<br>TGTCCCGGTATTTCTCCCAGCCAAACCGACCACGACTCCCGCCC<br>CGCGCCCTCCGACACCCGCTCCCACCATCGCCTCTCAACCTCTT<br>AGTCTTCGCCCCGAGGCATGCCGACCCGCCGCCGGGGGTGCTG<br>TTCATACGAGGGGCTTGGACTTCGCTTGTGATATTTACATTTGG<br>GCTCCGTTGGCGGGTACGTGCGGCGTCCTTTTGTTGTCACTCGT<br>TATTACTTTGTATTGTAATCACAGGAATCGCTCAAAGCGGAGT<br>AGGTTGTTGCATTCCGATTACATGAATATGACTCCTCGCCGGCC<br>TGGGCCGACAAGAAAACATTACCAACCCTATGCCCCCCCACGA<br>GACTTCGCTGCGTACAGGTCCCGAGTGAAGTTTTCCCGAAGCG<br>CAGACGCTCCGGCATATCAGCAAGGACAGAATCAGCTGTATAA<br>CGAACTGAATTTGGGACGCCGCGAGGAGTATGACGTGCTTGAT<br>AAACGCCGGGGAGAGACCCGGAAATGGGGGGTAAACCCCGA<br>AGAAAGAATCCCCAAGAAGGACTCTACAATGAACTCCAGAAG<br>GATAAGATGGCGGAGGCCTACTCAGAAATAGGTATGAAGGGC<br>GAACGACGACGGGGAAAAGGTCACGATGGCCTCTACCAAGGG<br>TTGAGTACGGCAACCAAAGATACGTACGATGCACTGCATATGC<br>AGGCCCTGCCTCCCAGATAATAATAAAATCGCTATCCATCGAA<br>GATGGATGTGTTGGTTTTTGTGTGCCAGTGACAAGTCTGTC<br>TGCCTATTCACCGATTTTGATTCTCAAACAAATGTGTCACAAAG<br>TAAGGATTCTGATGTGTATATCACAGACAAAACTGTGCTAGAC<br>ATGAGGTCTATGACTTCAAGAGCAACAGTGCTGTGGCCTGGA<br>GCAACAAATCTGACTTTGCATGTGCAAACGCCTTCAACAACAG<br>CATTATTCCAGAAGACACCTTCTTCCCCAGCCCAGGTAAGGGC<br>AGCTTTGGTGCCTTCGCAGGCTGTTTCCTTGCTTCAGGAATGGC |

TABLE 34-continued rAAV Sequences

| SEQ ID NO: | Description | Sequence |
|---|---|---|
| | | CAGGTTCTGCCCAGAGCTCTGGTCAATGATGTCTAAAACTCCTC |
| | | TGATTGGTGGTCTCGGCCTTATCCATTGCCACCAAAACCCTCTT |
| | | TTTACTAAGAAACAGTGAGCCTTGTTCTGGCAGTCCAGAGAAT |
| | | GACACGGGAAAAAAGCAGATGAAGAGAAGGTGGCAGGAGAG |
| | | GGCACGTGGCCCAGCCTCAGTCTCTCCAACTGAGTTCCTGCCTG |
| | | CCTGCCTTTGCTCAGACTGTTTGCCCCTTACTGCTCTTCTAGGCC |
| | | TCATTCTAAGCCCCTTCTCCAAGTTGCCTCTCCTTATTTCTCCCT |
| | | GTCTGCCAAAAAATCTTTCCCAGCTCACTAAGTCAGTCTCACGC |
| | | AGTCACTCATTAACCCACCAATCACTGATTGTGCCGGCACATG |
| | | AATGCACCAGGTGTTGAAGTGGAGGAATTAAAAAGTCAGATG |
| | | AGGGGTGTGCCCAGAGGAAGCACCATTCTAGTTGGGGGAGCCC |
| | | ATCTGTCAGCTGGGAAAAGTCCAAATAACTTCAGATTGGAATG |
| | | TGTTTTAACTCAGGGTTGAGAAAACAGCTACCTTCAGGACAAA |
| | | AGTCAGGGAAGGGCTCTCTGAAGAAATGCTACTTGAAGATACC |
| | | AGCCCTACCAAGGGCAGGGAGAGGACCCTATAGAGGCCTGGG |
| | | ACAGGAGCTCAATGAGAAAGGAGAAGAGCAGCAGGCATGAGT |
| | | TGAATGAAGGAGGCAGGGCCGGGTCACAGGGTAACCACGTGC |
| | | GGACCGAGGCTGCAGCGTCGTCCTCCCTAGGAACCCCTAGTGA |
| | | TGGAGTTGGCCACTCCCTCTCTGCGCGCTCGCTCGCTCACTGAG |
| | | GCCGCCCGGGCAAAGCCCGGGCGTCGGGCGACCTTTGGTCGCC |
| | | CGGCCTCAGTGAGCGAGCGAGCGCGCAGAGAGGGAGTGGCCA |
| | | A |
| 1357 | CTX-141 | CCTGCAGGCAGCTGCGCGCTCGCTCGCTCACTGAGGCCGCCCG |
| | | GGCAAAGCCCGGGCGTCGGGCGACCTTTGGTCGCCCGGCCTCA |
| | | GTGAGCGAGCGAGCGCGCAGAGAGGGAGTGGCCAACTCCATC |
| | | ACTAGGGGTTCCTGCGGCCGCACGCGTAATCCTCCGGCAAACC |
| | | TCTGTTTCCTCCTCAAAAGGCAGGAGGTCGGAAAGAATAAACA |
| | | ATGAGAGTCACATTAAAAACACAAAATCCTACGGAAATACTGA |
| | | AGAATGAGTCTCAGCACTAAGGAAAAGCCTCCAGCAGCTCCTG |
| | | CTTTCTGAGGGTGAAGGATAGACGCTGTGGCTCTGCATGACTC |
| | | ACTAGCACTCTATCACGGCCATATTCTGGCAGGGTCAGTGGCT |
| | | CCAACTAACATTTGTTTGGTACTTTACAGTTTATTAAATAGATG |
| | | TTTATATGGAGAAGCTCTCATTTCTTTCTCAGAAGAGCCTGGCT |
| | | AGGAAGGTGGATGAGGCACCCATATTCATTTTGCAGGTGAAATT |
| | | CCTGAGATGTAAGGAGCTGCTGTGACTTGCTCAAGGCCTTATA |
| | | TCGAGTAAACGGTAGTGCTGGGGCTTAGACGCAGGTGTTCTGA |
| | | TTTATAGTTCAAAACCTCTATCAATGAGAGCAATCTCCTGGT |
| | | AATGTGATAGATTTCCCAACTTAATGCCAACATACCATAAACC |
| | | TCCCATTCTGCTAATGCCCAGCCTAAGTTGGGGAGACCACTCC |
| | | AGATTCCAAGATGTACAGTTTGCTTTGCTGGGCCTTTTTCCCAT |
| | | GCCTGCCTTTACTCTGCCAGAGTTTATATTGCTGGGGTTTTGAAG |
| | | AAGATCCTATTAAATAAAAGAATAAGCAGTATTATTAAGTAGC |
| | | CCTGCATTTCAGGTTTCCTTGAGTGGCAGGCCAGGCCTGGCCGT |
| | | GAACGTTCACTGAAATCATGGCCTCTTGGCCAAGATTGATAGC |
| | | TTGTGCCTGTCCCTGAGTCCCAGTCCATCACGAGCAGCTGGTTT |
| | | CTAAGATGCTATTTCCCGTATAAAGCATGAGACCGTGACTTGC |
| | | CAGCCCCACAGAGCCCCGCCCTTGTCCATCACTGGCATCTGGA |
| | | CTCCAGCCTGGGTTGGGGCAAAGAGGGAAATGAGATCATGTCC |
| | | TAACCCTGATCCTCTTGTCCCACAGATATCGGAAGCGGAGCTA |
| | | CTAACTTCAGCCTGCTGAAGCAGGCTGGAGACGTGGAGGAGAA |
| | | CCCTGGACCCATGCTTCTTTTGGTTACGTCTCTGTTGCTTTGCGA |
| | | ACTTCCTCATCCAGCGTTCTTGCTGATCCCCGATATTCAGATGA |
| | | CTCAGACCACCAGTAGCTTGTCTGCCTCACTGGGAGACCGAGT |
| | | AACAATCTCCTGCAGGGCAAGTCAAGACATTAGCAAATACCTC |
| | | AATTGGTACCAGCAGAAGCCCGACGGAACGGTAAAACTCCTCA |
| | | TCTATCATACGTCAAGGTTGCATTCCGGAGTACCGTCACGATTT |
| | | TCAGGTTCTGGGAGCGGAACTGACTATTCCTTGACTATTTCAAA |
| | | CCTCGAGCAGGAGGACATTGCGACATATTTTTGTCAACAAGGT |
| | | AATACCCTCCCTTACACTTTCGGAGGAGGAACCAAACTCGAAA |
| | | TTACCGGGTCCACCAGTGGCTCTGGGAAGCCTGGCAGTGGAGA |
| | | AGGTTCCACTAAAGGCGAGGTGAAGCTCCAGGAGAGCGGCCC |
| | | CGGTCTCGTTGCCCCCAGTCAAAGCCTCTCTGTAACGTGCACAG |
| | | TGAGTGGTGTATCATTGCCTGATTATGGCGTCTCCTGGATAAGG |
| | | CAGCCCCCGCGAAAGGGTCTTGAATGGCTTGGGGTAATATGGG |
| | | GCTCAGAGACAACGTATTATAACTCCGCTCTCAAAAGTCGCTT |
| | | GACGATAATAAAAGATAACTCCAAGAGTCAAGTTTTCCTTAAA |
| | | ATGAACAGTTTCAGACTGACGATACCGCTATATATTATTGTGC |
| | | TAAACATTATTACTACGGCGGTAGTTACGCGATGGATTATTGG |
| | | GGGCAGGGGACTTCTGTCACAGTCAGTAGTGCTGCTGCCTTTGT |
| | | CCCGGTATTTCTCCCAGCCAAACCGACCACGACTCCCGCCCG |
| | | CGCCCTCCGACACCCGCTCCCACCATCGCCTCTCAACCTCTTAG |
| | | TCTTCGCCCCGAGGCATGCCGACCCGCCGCCGGGGTGCTGTT |
| | | CATACGAGGGGCTTGGACTTCGCTTGTGATATTTACATTTGGGC |
| | | TCCGTTGGCGGGTACGTGCGCGTCCTTTTGTTGTCACTCGTTA |
| | | TTACTTTGTATTGTAATCACAGGAATCGCTCAAAGCGGAGTAG |

TABLE 34-continued rAAV Sequences

| SEQ ID NO: | Description | Sequence |
|---|---|---|
| | | GTTGTTGCATTCCGATTACATGAATATGACTCCTCGCCGGCCTG GGCCGACAAGAAAACATTACCAACCCTATGCCCCCCCACGAGA CTTCGCTGCGTACAGGTCCCGAGTGAAGTTTTCCCGAAGCGCA GACGCTCCGGCATATCAGCAAGGACAGAATCAGCTGTATAACG AACTGAATTTGGGACGCCGCGAGGAGTATGACGTGCTTGATAA ACGCCGGGGAGAGACCCGGAAATGGGGGGTAAACCCCGAAG AAAGAATCCCCAAGAAGGACTCTACAATGAACTCCAGAAGGA TAAGATGGCGGAGGCCTACTCAGAAATAGGTATGAAGGGCGA ACGACGACGGGGAAAAGGTCACGATGGCCTCTACCAAGGGTT GAGTACGGCAACCAAAGATACGTACGATGCACTGCATATGCAG GCCCTGCCTCCCAGAGGAAGCGGAGCTACTAACTTCAGCCTGC TGAAGCAGGCTGGAGACGTGGAGGAGAACCCTGGACCTATGG TGAGCAAGGGCGAGGAGCTGTTCACCGGGGTGGTGCCCATCCT GGTCGAGCTGGACGGCGACGTAAACGGCCACAAGTTCAGCGTG TCCGGCGAGGGCGAGGGCGATGCCACCTACGGCAAGCTGACCC TGAAGTTCATCTGCACCACCGGCAAGCTGCCCGTGCCCTGGCC CACCCTCGTGACCACCCTGACCTACGGCGTGCAGTGCTTCAGC CGCTACCCCGACCACATGAAGCAGCACGACTTCTTCAAGTCCG CCATGCCCGAAGGCTACGTCCAGGAGCGCACCATCTTCTTCAA GGACGACGGCAACTACAAGACCCGCGCCGAGGTGAAGTTCGA GGGCGACACCCTGGTGAACCGCATCGAGCTGAAGGGCATCGAC TTCAAGGAGGACGGCAACATCCTGGGGCACAAGCTGGAGTAC AACTACAACAGCCACAACGTCTATATCATGGCCGACAAGCAGA AGAACGGCATCAAGGTGAACTTCAAGATCCGCCACAACATCGA GGACGGCAGCGTGCAGCTCGCCGACCACTACCAGCAGAACACC CCCATCGGCGACGGCCCCGTGCTGCTGCCCGACAACCACTACC TGAGCACCCAGTCCGCCCTGAGCAAAGACCCCAACGAGAAGC GCGATCACATGGTCCTGCTGGAGTTCGTGACCGCCGCCGGGAT CACTCTCGGCATGGACGAGCTGTACAAGTAATAATAAAATCGC TATCCATCGAAGATGGATGTGTGTTGGTTTTTTGTGTGCCAGTG ACAAGTCTGTCTGCCTATTCACCGATTTTGATTCTCAAACAAAT GTGTCACAAAGTAAGGATTCTGATGTGTATATCACAGACAAAA CTGTGCTAGACATGAGGTCTATGGACTTCAAGAGCAACAGTGC TGTGGCCTGGAGCAACAAATCTGACTTTGCATGTGCAAACGCC TTCAACAACAGCATTATTCCAGAAGACACCTTCTTCCCCAGCCC AGGTAAGGGCAGCTTTGGTGCCTTCGCAGGCTGTTTCCTTGCTT CAGGAATGGCCAGGTTCTGCCCAGAGCTCTGGTCAATGATGTC TAAAACTCCTCTGATTGGTGGTCTCGGCCTTATCCATTGCCACC AAAACCCTCTTTTTACTAAGAAACAGTGAGCCTTGTTCTGGCAG TCCAGAGAATGACACGGGAAAAAAGCAGATGAAGAGAAGGTG GCAGGAGAGGGCACGTGGCCCAGCCTCAGTCTCTCCAACTGAG TTCCTGCCTGCCTGCCTTTGCTCAGACTGTTTGCCCCTTACTGCT CTTCTAGGCCTCATTCTAAGCCCCTTCTCCAAGTTGCCTCTCCTT ATTTCTCCCTGTCTGCCAAAAAATCTTTCCCAGCTCACTAAGTC AGTCTCACGCAGTCACTCATTAACCCACCAATCACTGATTGTGC CGGCACATGAATGCACCAGGTGTTGAAGTGGAGGAATTAAAA AGTCAGATGAGGGGTGTGCCCAGAGGAAGCACCATTCTAGTTG GGGGAGCCCATCTGTCAGCTGGGAAAAGTCCAAATAACTTCAG ATTGGAATGTGTTTTAACTCAGGGTTGAGAAAACAGCTACCTT CAGGACAAAAGTCAGGGAAGGGCTCTCTGAAGAAATGCTACTT GAAGATACCAGCCCTACCAAGGGCAGGGAGAGGACCCTATAG AGGCCTGGGACAGGAGCTCAATGAGAAAGGAGAAGAGCAGCA GGCATGAGTTGAATGAAGGAGGCAGGGCCGGGTCACAGGGTA ACCACGTGCGGACCGAGGCTGCAGCGTCGTCCTCCCTAGGAAC CCCTAGTGATGGAGTTGGCCACTCCCTCTCTGCGCGCTCGCTCG CTCACTGAGGCCGGGCGACCAAAGGTCGCCCGACGCCCGGGCT TGCCCGGGCGGCCTCAGTGAGCGAGCGAGCGCGCAGCTGCCT GCAGG |
| 1358 | CTX-142 | CCTGCAGGCAGCTGCGCGCTCGCTCGCTCACTGAGGCCGCCCG GGCGTCGGGCGACCTTTGGTCGCCCGGCCTCAGTGAGCGAGCG AGCGCGCAGAGGGAGTGGCCAACTCCATCACTAGGGGTTCC TGCCGGCCGCACGCGTGAGATGTAAGGAGCTGCTGTGACTTGCT CAAGGCCTTATATCGAGTAAACGGTAGTGCTGGGGCTTAGACG CAGGTGTTCTGATTTATAGTTCAAAACCTCTATCAATGAGAGA GCAATCTCCTGGTAATGTGATAGATTTCCCAACTTAATGCCAAC ATACCATAAACCTCCCATTCTGCTAATGCCCAGCCTAAGTTGGG GAGACCACTCCAGATTCCAAGATGTACAGTTTGCTTTGCTGGG CCTTTTTCCCATGCCTGCCTTTACTCTGCCAGAGTTATATTGCTG GGGTTTTGAAGAAGATCCTATTAAATAAAAGAATAAGCAGTAT TATTAAGTAGCCCTGCATTTCAGGTTTCCTTGAGTGGCAGGCCA GGCCTGGCCGTGAACGTTCACTGAAATCATGGCCTCTTGGCCA AGATTGATAGCTTGTGCCTGTCCCTGAGTCCCAGTCCATCACGA GCAGCTGGTTTCTAAGATGCTATTTCCCGTATAAAGCATGAGA CCGTGACTTGCCAGCCCCACAGAGCCCCGCCCTTGTCCATCACT GGCATCTGGACTCCAGCCTGGGTTGGGGCAAAGAGGGAAATG |

TABLE 34-continued rAAV Sequences

| SEQ ID NO: | Description | Sequence |
|---|---|---|
| | | AGATCATGTCCTAACCCTGATCCTCTTGTCCCACAGATATCCAG |
| | | AACCCTGACCCTGCCGTGTACCAGCTGAGAGACTCTAAATCCA |
| | | GTGACAAGTCTGTCTGCCTATTCACCGATTTTGATTCTCAAACA |
| | | AATGTGTCACAAAGTAAGGATTCTGATGTGTATATCACAGACA |
| | | AAACTGTGCTAGACATGAGGTCTATGGACTTCAGGCTCCGGTG |
| | | CCCGTCAGTGGGCAGAGCGCACATCGCCCACAGTCCCCGAGAA |
| | | GTTGGGGGGAGGGGTCGGCAATTGAACCGGTGCCTAGAGAAG |
| | | GTGGCGCGGGGTAAACTGGGAAAGTGATGTCGTGTACTGGCTC |
| | | CGCCTTTTTCCCGAGGGTGGGGGAGAACCGTATATAAGTGCAG |
| | | TAGTCGCCGTGAACGTTCTTTTTCGCAACGGGTTTGCCGCCAGA |
| | | ACACAGGTAAGTGCCGTGTGTGGTTCCCGCGGGCCTGGCCTCT |
| | | TTACGGGTTATGGCCCTTGCGTGCCTTGAATTACTTCCACTGGC |
| | | TGCAGTACGTGATTCTTGATCCCGAGCTTCGGGTTGGAAGTGG |
| | | GTGGGAGAGTTCGAGGCCTTGCGCTTAAGGAGCCCCTTCGCCT |
| | | CGTGCTTGAGTTGAGGCCTGGCCTGGGCGCTGGGGCCGCCGCG |
| | | TGCGAATCTGGTGGCACCTTCGCGCCTGTCTCGCTGCTTTCGAT |
| | | AAGTCTCTAGCCATTTAAAATTTTTGATGACCTGCTGCGACGCT |
| | | TTTTTTCTGGCAAGATAGTCTTGTAAATGCGGGCCAAGATCTGC |
| | | ACACTGGTATTTCGGTTTTTGGGGCCGCGGGCGGCGACGGGGC |
| | | CCGTGCGTCCCAGCGCACATGTTCGGCGAGGCGGGGCCTGCGA |
| | | GCGCGGCCACCGAGAATCGGACGGGGGTAGTCTCAAGCTGGCC |
| | | GGCCTGCTCTGGTGCCTGGCCTCGCGCCGCCGTGTATCGCCCCG |
| | | CCCTGGGCGGCAAGGCTGGCCCGGTCGGCACCAGTTGCGTGAG |
| | | CGGAAAGATGGCCGCTTCCCGGCCCTGCTGCAGGGAGCTCAAA |
| | | ATGGAGGACGCGGCGCTCGGGAGAGCGGGCGGGTGAGTCACC |
| | | CACACAAAGGAAAAGGGCCTTTCCGTCCTCAGCCGTCGCTTCA |
| | | TGTGACTCCACGGAGTACCGGGCGCCGTCCAGGCACCTCGATT |
| | | AGTTCTCGAGCTTTTGGAGTACGTCGTCTTTAGGTTGGGGGGAG |
| | | GGGTTTTATGCGATGGAGTTTCCCCACACTGAGTGGGTGGAGA |
| | | CTGAAGTTAGGCCAGCTTGGCACTTGATGTAATTCTCCTTGGAA |
| | | TTTGCCCTTTTTGAGTTTGGATCTTGGTTCATTCTCAAGCCTCAG |
| | | ACAGTGGTTCAAAGTTTTTTTCTTCCATTTCAGGTGTCGTGACC |
| | | ACCATGGCGCTTCCGGTGACAGCACTGCTCCTCCCCTTGGCGCT |
| | | GTTGCTCCACGCAGCAAGGCCGGATATAGTTATGACCCAATCA |
| | | CCCGATAGTCTTGCGGTAAGCCTGGGGGAGCGAGCAACAATAA |
| | | ACTGTCGGGCATCAAAATCCGTCAGTACAAGCGGGTATTCATT |
| | | CATGCACTGGTATCAACAGAAACCCGGTCAGCCACCCAAGCTC |
| | | CTGATTTATCTTGCGTCTAATCTTGAGTCCGGCGTCCCAGACCG |
| | | GTTTTCCGGCTCCGGGAGCGGCACGGATTTTACTCTTACTATTT |
| | | CTAGCCTTCAGGCCGAAGATGTGGCGGTATACTACTGCCAGCA |
| | | TTCAAGGGAAGTTCCTTGGACGTTCGGTCAGGGCACGAAAGTG |
| | | GAAATTAAAGGCGGGGGGGATCCGGCGGGGAGGGTCTGGA |
| | | GGAGGTGGCAGTGGTCAGGTCCAACTGGTGCAGTCCGGGGCAG |
| | | AGGTAAAAAAACCCGGCGCGTCTGTTAAGGTTTCATGCAAGGC |
| | | CAGTGGATATACTTTCACCAATTACGGAATGAACTGGGTGAGG |
| | | CAGGCCCCTGGTCAAGGCCTGAAATGGATGGGATGGATAAACA |
| | | CGTACACCGGTGAACCTACCTATGCCGATGCCTTTAAGGGTCG |
| | | GGTTACGATGACGAGAGACACCTCCATATCAACAGCCTACATG |
| | | GAGCTCAGCAGATTGAGGAGTGACGATACGGCAGTCTATTACT |
| | | GTGCAAGAGACTACGGCGATTATGGCATGGATTACTGGGGCCA |
| | | GGGCACTACAGTAACCGTTTCCAGCAGTGCTGCTGCCTTTGTCC |
| | | CGGTATTCTCCCAGCCAAACCGACCACGACTCCCGCCCCGCG |
| | | CCCTCCGACACCCGCTCCCACCATCGCCTCTCAACCTCTTAGTC |
| | | TTCGCCCCGAGGCATGCCGACCCGCCGCCGGGGGTGCTGTTCA |
| | | TACGAGGGGCTTGGACTTCGCTTGTGATATTTACATTTGGGCTC |
| | | CGTTGGCGGGTACGTGCGGCGTCCTTTTGTTGTCACTCGTTATT |
| | | ACTTTGTATTGTAATCACAGGAATCGCTCAAAGCGGAGTAGGT |
| | | TGTTGCATTCCGATTACATGAATATGACTCCTCGCCGGCCTGGG |
| | | CCGACAAGAAAACATTACCAACCCTATGCCCCCCCACGAGACT |
| | | TCGCTGCGTACAGGTCCCGAGTGAAGTTTTCCCGAAGCGCAGA |
| | | CGCTCCGGCATATCAGCAAGGACAGAATCAGCTGTATAACGAA |
| | | CTGAATTTGGGACGCCGCGAGGAGTATGACGTGCTTGATAAAC |
| | | GCCGGGGAGAGACCCGGAAATGGGGGTAAACCCCGAAGAA |
| | | AGAATCCCCAAGAAGGACTCTACAATGAACTCCAGAAGGATA |
| | | AGATGGCGGAGGCCTACTCAGAAATAGGTATGAAGGGCGAAC |
| | | GACGACGGGGAAAAGGTCACGATGGCCTCTACCAAGGGTTGA |
| | | GTACGGCAACCAAAGATACGTACGATGCACTGCATATGCAGGC |
| | | CCTGCCTCCCAGATAATAATAAAATCGCTATCCATCGAAGATG |
| | | GATGTGTGTTGGTTTTTTGTGTGTGGAGCAACAAATCTGACTTT |
| | | GCATGTGCAAACGCCTTCAACAACAGCATTATTCCAGAAGACA |
| | | CCTTCTTCCCCAGCCCAGGTAAGGGCAGCTTTGGTGCCTTCCGA |
| | | GGCTGTTTCCTTGCTTCAGGAATGGCCAGGTTCTGCCCAGAGCT |
| | | CTGGTCAATGATGTCTAAAACTCCTCTGATTGGTGGTCTCGGCC |
| | | TTATCCATTGCCACCAAAACCCTCTTTTTACTAAGAAACAGTGA |
| | | GCCTTGTTCTGGCAGTCCAGAGAATGACACGGGAAAAAAGCAG |
| | | ATGAAGAGAAGGTGGCAGGAGAGGGCACGTGGCCCAGCCTCA |

TABLE 34-continued rAAV Sequences

| SEQ ID NO: | Description | Sequence |
|---|---|---|
| | | GTCTCTCCAACTGAGTTCCTGCCTGCCTGCCTTTGCTCAGACTG<br>TTTGCCCCTTACTGCTCTTCTAGGCCTCATTCTAAGCCCCTTCTC<br>CAAGTTGCCTCTCCTTATTTCTCCCTGTCTGCCAAAAAATCTTTC<br>CCAGCTCACTAAGTCAGTCTCACGCAGTCACTCATTAACCCACC<br>AATCACTGATTGTGCCGGCACATGAATGCACCAGGTGTTGAAG<br>TGGAGGAATTAAAAAGTCAGATGAGGGGTGTGCCCAGAGGAA<br>GCACCATTCTAGTTGGGGGAGCCCATCTGTCAGCTGGGAAAAG<br>TCCAAATAACTTCAGATTGGAATGTGTTTTAACTCAGGGTTGAG<br>AAAACAGCTACCTTCAGGACAAAAGTCAGGGAAGGGCTCTCTG<br>AAGAAATGCTACTTGAAGATACCAGCCCTACCAAGGGCAGGG<br>AGAGGACCCTATAGAGGCCTGGGACAGGAGCTCAATGAGAAA<br>GGTAACCACGTGCGGACCGAGGCTGCAGCGTCGTCCTCCCTAG<br>GAACCCCTAGTGATGGAGTTGGCCACTCCCTCTCTGCGCGCTCG<br>CTCGCTCACTGAGGCCGGGCGACCAAAGGTCGCCCGACGCCCG<br>GGCTTTGCCCGGGCGGCCTCAGTGAGCGAGCGAGCGCGCAGCT<br>GCCTGCAGG |
| 1359 | CTX-145 | CCTGCAGGCAGCTGCGCGCTCGCTCGCTCACTGAGGCCGCCCG<br>GGCGTCGGGCGACCTTTGGTCGCCCGGCCTCAGTGAGCGAGCG<br>AGCGCGCAGAGAGGGAGTGGCCAACTCCATCACTAGGGGTTCC<br>TGCGGCCGCACGCGTGAGATGTAAGGAGCTGCTGTGACTTGCT<br>CAAGGCCTTATATCGAGTAAACGGTAGTGCTGGGGCTTAGACG<br>CAGGTGTTCTGATTTATAGTTCAAAACCTCTATCAATGAGAGA<br>GCAATCTCCTGGTAATGTGATAGATTTCCCAACTTAATGCCAAC<br>ATACCATAAACCTCCCATTCTGCTAATGCCCAGCCTAAGTTGGG<br>GAGACCACTCCAGATTCCAAGATGTACAGTTTGCTTTGCTGGG<br>CCTTTTTCCCATGCCTGCCTTTACTCTGCCAGAGTTATATTGCTG<br>GGGTTTTGAAGAAGATCCTATTAAATAAAAGAATAAGCAGTAT<br>TATTAAGTAGCCCTGCATTTCAGGTTTCCTTGAGTGGCAGGCCA<br>GGCCTGGCCGTGAACGTTCACTGAAATCATGGCCTCTTGGCCA<br>AGATTGATAGCTTGTGCCTGTCCCTGAGTCCCAGTCCATCACGA<br>GCAGCTGGTTTCTAAGATGCTATTTCCCGTATAAAGCATGAGA<br>CCGTGACTTGCCAGCCCCACAGAGCCCCGCCCTTGTCCATCACT<br>GGCATCTGGACTCCAGCCTGGGTTGGGGCAAAGAGGGAAATG<br>AGATCATGTCCTAACCCTGATCCTCTTGTCCCACAGATATCCAG<br>AACCCTGACCCTGCCGTGTACCAGCTGAGAGACTCTAAATCCA<br>GTGACAAGTCTGTCTGCCTATTCACCGATTTTGATTCTCAAACA<br>AATGTGTCACAAAGTAAGGATTCTGATGTGTATATCACAGACA<br>AAACTGTGCTAGACATGAGGTCTATGGACTTCAGGCTCCGGTG<br>CCCGTCAGTGGGCAGAGCGCACATCGCCCACAGTCCCCGAGAA<br>GTTGGGGGAGGGGTCGGCAATTGAACCGGTGCCTAGAGAAG<br>GTGGCGCGGGGTAAACTGGGAAAGTGATGTCGTGTACTGGCTC<br>CGCCTTTTTCCCGAGGGTGGGGGAGAACCGTATATAAGTGCAG<br>TAGTCGCCGTGAACGTTCTTTTTCGCAACGGGTTTGCCGCCAGA<br>ACACAGGTAAGTGCCGTGTGTGGTTCCCGCGGGCCTGGCCTCT<br>TTACGGGTTATGGCCCTTGCGTGCCTTGAATTACTTCCACTGGC<br>TGCAGTACGTGATTCTTGATCCCGAGCTTCGGGTTGGAAGTGG<br>GTGGGAGAGTTCGAGGCCTTGCGCTTAAGGAGCCCCTTCGCCT<br>CGTGCTTGAGTTGAGGCCTGGCCTGGGCGCTGGGGCCGCCGCG<br>TGCGAATCTGGTGGCACCTTCGCGCCTGTCTCGCTGCTTTCGAT<br>AAGTCTCTAGCCATTTAAAATTTTTGATGACCTGCTGCGACGCT<br>TTTTTTCTGGCAAGATAGTCTTGTAAATGCGGGCCAAGATCTGC<br>ACACTGGTATTTCGGTTTTTGGGCCGCGGGCGGCGACGGGGC<br>CCGTGCGTCCCAGCGCACATGTTCGGCGAGGCGGGGCCTGCGA<br>GCGCGGCCACCGAGAATCGGACGGGGGTAGTCTCAAGCTGGCC<br>GGCCTGCTCTGGTGCCTGGCCTCGCGCCGCCGTGTATCGCCCCG<br>CCCTGGGCGGCAAGGCTGGCCCGGTCGGCACCAGTTGCGTGAG<br>CGGAAAGATGGCCGCTTCCCGGCCCTGCTGCAGGGAGCTCAAA<br>ATGGAGGACGCGGCGCTCGGGAGAGCGGGCGGGTGAGTCACC<br>CACACAAAGGAAAAGGGCCTTTCCGTCCTCAGCCGTCGCTTCA<br>TGTGACTCCACGGAGTACCGGGCGCCGTCCAGGCACCTCGATT<br>AGTTCTCGAGCTTTTGGAGTACGTCGTCTTTAGGTTGGGGGGAG<br>GGGTTTTATGCGATGGAGTTTCCCCACACTGAGTGGGTGGAGA<br>CTGAAGTTAGGCCAGCTTGGCACTTGATGTAATTCTCCTTGGAA<br>TTTGCCCTTTTTGAGTTTGGATCTTGGTTCATTCTCAAGCCTCAG<br>ACAGTGGTTCAAAGTTTTTTTCTTCCATTTCAGGTGTCGTGACC<br>ACCATGGCGCTTCCGGTGACAGCACTGCTCCTCCCCTTGGCGCT<br>GTTGCTCCACGCAGCAAGGCCGCAGGTCCAGTTGGTGCAAAGC<br>GGGGCGGAGGTGAAAAAACCCGGCGCTTCCGTGAAGGTGTCCT<br>GTAAGGCGTCCGGTTATACGTTCACGAACTACGGGATGAATTG<br>GGTTCGCCAAGCGCCGGGGCAGGGACTGAAATGGATGGGGTG<br>GATAAATACCTACACCGGCGAACCTACATACGCCGACGCTTTT<br>AAAGGGCGAGTCACTATGACGCGCGATACCAGCATATCCACCG<br>CATACATGGAGCTGTCCCGACTCCGGTCAGACGACACGGCTGT<br>CTACTATTGTGCTCGGGACTATGGCGATTATGGCATGGACTACT<br>GGGGTCAGGGTACGACTGTAACAGTTAGTAGTGGTGGAGGCGG |

TABLE 34-continued rAAV Sequences

| SEQ ID NO: | Description | Sequence |
|---|---|---|
| | | CAGTGGCGGGGGGGAAGCGGAGGAGGGGGTTCTGGTGACAT
AGTTATGACCCAATCCCCAGATAGTTTGGCGGTTTCTCTGGGCG
AGAGGGCAACGATTAATTGTCGCGCATCAAAGAGCGTTTCAAC
GAGCGGATATTCTTTTATGCATTGGTACCAGCAAAAACCCGGA
CAACCGCCGAAGCTGCTGATCTACTTGGCTTCAAATCTTGAGTC
TGGGGTGCCGGACCGATTTTCTGGTAGTGGAAGCGGAACTGAC
TTTACGCTCACGATCAGTTCACTGCAGGCTGAGGATGTAGCGG
TCTATTATTGCCAGCACAGTAGAGAAGTCCCCTGGACCTTCGGT
CAAGGCACGAAAGTAGAAATTAAAAGTGCTGCTGCCTTTGTCC
CGGTATTTCTCCCAGCCAAACCGACCACGACTCCCGCCCCGCG
CCCTCCGACACCCGCTCCCACCATCGCCTCTCAACCTCTTAGTC
TTCGCCCCGAGGCATGCCGACCCGCCGCCGGGGGTGCTGTTCA
TACGAGGGGCTTGGACTTCGCTTGTGATATTTACATTTGGGCTC
CGTTGGCGGGTACGTGCGGCGTCCTTTTGTTGTCACTCGTTATT
ACTTTGTATTGTAATCACAGGAATCGCTCAAAGCGGAGTAGGT
TGTTGCATTCCGATTACATGAATATGACTCCTCGCCGGCCTGGG
CCGACAAGAAAACATTACCAACCCTATGCCCCCCCACGAGACT
TCGCTGCGTACAGGTCCCGAGTGAAGTTTTCCCGAAGCGCAGA
CGCTCCGGCATATCAGCAAGGACAGAATCAGCTGTATAACGAA
CTGAATTTGGGACGCCGCGAGGAGTATGACGTGCTTGATAAAC
GCCGGGGAGAGACCCGGAAATGGGGGTAAACCCCGAAGAA
AGAATCCCCAAGAAGGACTCTACAATGAACTCCAGAAGGATA
AGATGGCGGAGGCCTACTCAGAAATAGGTATGAAGGGCGAAC
GACGACGGGGAAAAGGTCACGATGGCCTCTACCAAGGGTTGA
GTACGGCAACCAAAGATACGTACGATGCACTGCATATGCAGGC
CCTGCCTCCCAGATAATAATAAAATCGCTATCCATCGAAGATG
GATGTGTGTTGGTTTTTTGTGTGTGGAGCAACAAATCTGACTTT
GCATGTGCAAACGCCTTCAACAACAGCATTATTCCAGAAGACA
CCTTCTTCCCCAGCCCAGGTAAGGGCAGCTTTGGTGCCTTCGCA
GGCTGTTTCCTTGCTTCAGGAATGGCCAGGTTCTGCCCAGAGCT
CTGGTCAATGATGTCTAAAACTCCTCTGATTGGTGGTCTCGGCC
TTATCCATTGCCACCAAAACCCTCTTTTTACTAAGAAACAGTGA
GCCTTGTTCTGGCAGTCCAGAGAATGACACGGGAAAAAGCAG
ATGAAGAGAAGGTGGCAGGAGAGGGCACGTGGCCCAGCCTCA
GTCTCTCCAACTGAGTTCCTGCCTGCCTGCCTTTGCTCAGACTG
TTTGCCCCTTACTGCTCTTCTAGGCCTCATTCTAAGCCCCTTCTC
CAAGTTGCCTCTCCTTATTTCTCCCTGTCTGCCAAAAAATCTTTC
CCAGCTCACTAAGTCAGTCTCACGCAGTCACTCATTAACCCACC
AATCACTGATTGTGCCGGCACATGAATGCACCAGGTGTTGAAG
TGGAGGAATTAAAAAGTCAGATGAGGGGTGTGCCCAGAGGAA
GCACCATTCTAGTTGGGGGAGCCCATCTGTCAGCTGGGAAAAG
TCCAAATAACTTCAGATTGGAATGTGTTTTAACTCAGGGTTGAG
AAAACAGCTACCTTCAGGACAAAAGTCAGGGAAGGGCTCTCTG
AAGAAATGCTACTTGAAGATACCAGCCCTACCAAGGGCAGGG
AGAGGACCCTATAGAGGCCTGGGACAGGAGCTCAATGAGAAA
GGTAACCACGTGCGGACCGAGGCTGCAGCGTCGTCCTCCCTAG
GAACCCCTAGTGATGGAGTTGGCCACTCCCTCTCTGCGCGCTCG
CTCGCTCACTGAGGCCGGGCGACCAAAGGTCGCCCGACGCCCG
GGCTTTGCCCGGGCGGCCTCAGTGAGCGAGCGAGCGCGCAGCT
GCCTGCAGG |
| 1360 | CTX-145b | CCTGCAGGCAGCTGCGCGCTCGCTCGCTCACTGAGGCCGCCCG
GGCGTCGGGCGACCTTTGGTCGCCCGGCCTCAGTGAGCGAGCG
AGCGCGCAGAGAGGGAGTGGCCAACTCCATCACTAGGGGTTCC
TGCGGCCGCACGCGTGAGATGTAAGGAGCTGCTGTGACTTGCT
CAAGGCCTTATATCGAGTAAACGGTAGTGCTGGGGCTTAGACG
CAGGTGTTCTGATTTATAGTTCAAAACCTCTATCAATGAGAGA
GCAATCTCCTGGTAATGTGATAGATTTCCCAACTTAATGCCAAC
ATACCATAAACCTCCCATTCTGCTAATGCCCAGCCTAAGTTGGG
GAGACCACTCCAGATTCCAAGATGTACAGTTTGCTTTGCTGGG
CCTTTTTCCCATGCCTGCCTTTACTCTGCCAGAGTTATATTGCTG
GGGTTTTGAAGAAGATCCTATTAAATAAAAGAATAAGCAGTAT
TATTAAGTAGCCCTGCATTTCAGGTTTCCTTGAGTGGCAGGCCA
GGCCTGGCCGTGAACGTTCACTGAAATCATGGCCTCTTGGCCA
AGATTGATAGCTTGTGCCTGTCCCTGAGTCCCAGTCCATCACGA
GCAGCTGGTTTCTAAGATGCTATTTCCCGTATAAAGCATGAGA
CCGTGACTTGCCAGCCCCACAGAGCCCCGCCCTTGTCCATCACT
GGCATCTGGACTCCAGCCTGGGTTGGGCAAAGAGGGAAATG
AGATCATGTCCTAACCCTGATCCTCTTGTCCCACAGATATCCAG
AACCCTGACCCTGCCGTGTACCAGCTGAGAGACTCTAAATCCA
GTGACAAGTCTGTCTGCCTATTCACCGATTTTGATTCTCAAACA
AATGTGTCACAAAGTAAGGATTCTGATGTGTATATCACAGACA
AAACTGTGCTAGACATGAGGTCTATGGACTTCAGGCTCCGGTG
CCCGTCAGTGGGCAGAGCGCACATCGCCCACAGTCCCCGAGAA
GTTGGGGGAGGGGTCGGCAATTGAACCGGTGCCTAGAGAAG
GTGGCGCGGGGTAAACTGGGAAAGTGATGTCGTGTACTGGCTC |

TABLE 34-continued rAAV Sequences

SEQ ID NO:Description Sequence

CGCCTTTTTCCCGAGGGTGGGGGAGAACCGTATATAAGTGCAG
TAGTCGCCGTGAACGTTCTTTTTCGCAACGGGTTTGCCGCCAGA
ACACAGGTAAGTGCCGTGTGTGGTTCCCGCGGGCCTGGCCTCT
TTACGGGTTATGGCCCTTGCGTGCCTTGAATTACTTCCACTGGC
TGCAGTACGTGATTCTTGATCCCGAGCTTCGGGTTGGAAGTGG
GTGGGAGAGTTCGAGGCCTTGCGCTTAAGGAGCCCCTTCGCCT
CGTGCTTGAGTTGAGGCCTGGCCTGGGCGCTGGGGCCGCCGCG
TGCGAATCTGGTGGCACCTTCGCGCCTGTCTCGCTGCTTTCGAT
AAGTCTCTAGCCATTTAAAATTTTTGATGACCTGCTGCGACGCT
TTTTTTCTGGCAAGATAGTCTTGTAAATGCGGGCCAAGATCTGC
ACACTGGTATTTCGGTTTTTGGGGCCGCGGGCGGCGACGGGGC
CCGTGCGTCCCAGCGCACATGTTCGGCGAGGCGGGGCCTGCGA
GCGCGGCCACCGAGAATCGGACGGGGGTAGTCTCAAGCTGGCC
GGCCTGCTCTGGTGCCTGGCCTCGCGCCGCCGTGTATCGCCCCG
CCCTGGGCGGCAAGGCTGGCCCGGTCGGCACCAGTTGCGTGAG
CGGAAAGATGGCCGCTTCCCGGCCCTGCTGCAGGGAGCTCAAA
ATGGAGGACGCGGCGCTCGGGAGAGCGGGCGGGTGAGTCACC
CACACAAAGGAAAAGGGCCTTTCCGTCCTCAGCCGTCGCTTCA
TGTGACTCCACGGAGTACCGGGCGCCGTCCAGGCACCTCGATT
AGTTCTCGAGCTTTTGGAGTACGTCGTCTTTAGGTTGGGGGGAG
GGGTTTTATGCGATGGAGTTTCCCCACACTGAGTGGGTGGAGA
CTGAAGTTAGGCCAGCTTGGCACTTGATGTAATTCTCCTTGGAA
TTTGCCCTTTTTGAGTTTGGATCTTGGTTCATTCTCAAGCCTCAG
ACAGTGGTTCAAAGTTTTTTTCTTCCATTTCAGGTGTCGTGACC
ACCATGGCGCTTCCGGTGACAGCACTGCTCCTCCCCTTGGCGCT
GTTGCTCCACGCAGCAAGGCCGCAGGTCCAGTTGGTGCAAAGC
GGGGCGGAGGTGAAAAAACCCGGCGCTTCCGTGAAGGTGTCCT
GTAAGGCGTCCGGTTATACGTTCACGAACTACGGGATGAATTG
GGTTCGCCAAGCGCCGGGGCAGGGACTGAAATGGATGGGGTG
GATAAATACCTACACCGGCGAACCTACATACGCCGACGCTTTT
AAAGGGCGAGTCACTATGACGCGCGATACCAGCATATCCACCG
CATACATGGAGCTGTCCCGACTCCGGTCAGACGACACGGCTGT
CTACTATTGTGCTCGGGACTATGGCGATTATGGCATGGACTACT
GGGGTCAGGGTACGACTGTAACAGTTAGTAGTGGTGGAGGCGG
CAGTGGCGGGGGGGAAGCGGAGGAGGGGGTTCTGGTGACAT
AGTTATGACCCAATCCCCAGATAGTTTGGCGGTTTCTCTGGGCG
AGAGGGCAACGATTAATTGTCGCGCATCAAAGAGCGTTTCAAC
GAGCGGATATTCTTTTATGCATTGGTACCAGCAAAAACCCGGA
CAACCGCCGAAGCTGCTGATCTACTTGGCTTCAAATCTTGAGTC
TGGGGTGCCGGACCGATTTTCTGGTAGTGGAAGCGGAACTGAC
TTTACGCTCACGATCAGTTCACTGCAGGCTGAGGATGTAGCGG
TCTATTATTGCCAGCACAGTAGAGAAGTCCCCTGGACCTTCGGT
CAAGGCACGAAAGTAGAAATTAAAAGTGCTGCTGCCTTTGTCC
CGGTATTCTCCCAGCCAAACCGACCACGACTCCCGCCCCGCG
CCCTCCGACACCCGCTCCCACCATCGCCTCTCAACCTCTTAGTC
TTCGCCCCGAGGCATGCCGACCCGCCGCCGGGGGTGCTGTTCA
TACGAGGGGCTTGGACTTCGCTTGTGATATTTACATTTGGGCTC
CGTTGGCGGGTACGTGCGGCGTCCTTTTGTTGTCACTCGTTATT
ACTTTGTATTGTAATCACAGGAATCGCAAACGGGGCAGAAAGA
AACTCCTGTATATATTCAAACAACCATTTATGAGACCAGTACA
AACTACTCAAGAGGAAGATGGCTGTAGCTGCCGATTTCCAGAA
GAAGAAGAAGGAGGATGTGAACTGCGAGTGAAGTTTTCCCGA
AGCGCAGACGCTCCGGCATATCAGCAAGGACAGAATCAGCTGT
ATAACGAACTGAATTTGGGACGCCGCGAGGAGTATGACGTGCT
TGATAAACGCCGGGGAGAGACCCGGAAATGGGGGGTAAACC
CCGAAGAAAGAATCCCCAAGAAGGACTCTACAATGAACTCCA
GAAGGATAAGATGGCGGAGGCCTACTCAGAAATAGGTATGAA
GGGCGAACGACGACGGGGAAAAGGTCACGATGGCCTCTACCA
AGGGTTGAGTACGGCAACCAAAGATACGTACGATGCACTGCAT
ATGCAGGCCCTGCCTCCCAGATAATAATAAAATCGCTATCCAT
CGAAGATGGATGTGTGTTGGTTTTTTGTGTGTGGAGCAACAAAT
CTGACTTTGCATGTGCAAACGCCTTCAACAACAGCATTATTCCA
GAAGCACCCTTCTTCCCCAGCCCAGGTAAGGGCAGCTTTGGTG
CCTTCGCAGGCTGTTTCCTTGCTTCAGGAATGGCCAGGTTCTGC
CCAGAGCTCTGGTCAATGATGTCTAAAACTCCTCTGATTGGTGG
TCTCGGCCTTATCCATTGCCACCAAAACCCTCTTTTTACTAAGA
AACAGTGAGCCTTGTTCTGGCAGTCCAGAGAATGACACGGGAA
AAAAGCAGATGAAGAGAAGGTGGCAGGAGAGGGCACGTGGCC
CAGCCTCAGTCTCTCCAACTGAGTTCCTGCCTGCCTGCCTTTGC
TCAGACTGTTTGCCCCTTACTGCTCTTCTAGGCCTCATTCTAAG
CCCCTTCTCCAAGTTGCCTCTCCTTATTTCTCCCTGTCTGCCAAA
AAATCTTTCCCAGCTCACTAAGTCAGTCTCACGCAGTCACTCAT
TAACCCACCAATCACTGATTGTGCCGGCACATGAATGCACCAG
GTGTTGAAGTGGAGGAATTAAAAAGTCAGATGAGGGGTGTGCC
CAGAGGAAGCACCATTCTAGTTGGGGAGCCCATCTGTCAGCT
GGGAAAAGTCCAAATAACTTCAGATTGGAATGTGTTTTAACTC

TABLE 34-continued rAAV Sequences

| SEQ ID NO: | Description | Sequence |
|---|---|---|
| | | AGGGTTGAGAAAACAGCTACCTTCAGGACAAAAGTCAGGGAA |
| | | GGGCTCTCTGAAGAAATGCTACTTGAAGATACCAGCCCTACCA |
| | | AGGGCAGGGAGAGGACCCTATAGAGGCCTGGGACAGGAGCTC |
| | | AATGAGAAAGGTAACCACGTGCGGACCGAGGCTGCAGCGTCG |
| | | TCCTCCCTAGGAACCCCTAGTGATGGAGTTGGCCACTCCCTCTC |
| | | TGCGCGCTCGCTCGCTCACTGAGGCCGGGCGACCAAAGGTCGC |
| | | CCGACGCCCGGGCTTTGCCCGGGCGGCCTCAGTGAGCGAGCGA |
| | | GCGCGCAGCTGCCTGCAGG |
| 1361 | CTX-152 | CCTGCAGGCAGCTGCGCGCTCGCTCGCTCACTGAGGCCGCCCG |
| | | GGCAAAGCCCGGGCGTCGGGCGACCTTTGGTCGCCCGGCCTCA |
| | | GTGAGCGAGCGAGCGCGCAGAGAGGGAGTGGCCAACTCCATC |
| | | ACTAGGGGTTCCTGCGGCCGCACGCGTGAAGATCCTATTAAAT |
| | | AAAAGAATAAGCAGTATTATTAAGTAGCCCTGCATTTCAGGTT |
| | | TCCTTGAGTGGCAGGCCAGGCCTGGCCGTGAACGTTCACTGAA |
| | | ATCATGGCCTCTTGGCCAAGATTGATAGCTTGTGCCTGTCCCTG |
| | | AGTCCCAGTCCATCACGAGCAGCTGGTTTCTAAGATGCTATTTC |
| | | CCGTATAAAGCATGAGACCGTGACTTGCCAGCCCCACAGAGCC |
| | | CCGCCCTTGTCCATCACTGGCATCTGGACTCCAGCCTGGGTTGG |
| | | GGCAAAGAGGGAAATGAGATCATGTCCTAACCCTGATCCTCTT |
| | | GTCCCACAGATATCCAGAACCCTGACCCTGCCGTGTACCAGCT |
| | | GAGAGACTCTAAATCCAGTGACAAGTCTGTCTGCCTATTCACC |
| | | GATTTTGATTCTCAAACAAATGTGTCACAAAGTAAGGATTCTG |
| | | ATGTGTATATCACAGACAAAACTGTGCTAGACATGAGGTCTAT |
| | | GGACTTCAGGCTCCGGTGCCCGTCAGTGGGCAGAGCGCACATC |
| | | GCCCACAGTCCCCGAGAAGTTGGGGGGAGGGGTCGGCAATTG |
| | | AACCGGTGCCTAGAGAAGGTGGCGCGGGGTAAACTGGGAAAG |
| | | TGATGTCGTGTACTGGCTCCGCCTTTTTCCCGAGGGTGGGGGAG |
| | | AACCGTATATAAGTGCAGTAGTCGCCGTGAACGTTCTTTTTCGC |
| | | AACGGGTTTGCCGCCAGAACACAGGTAAGTGCCGTGTGTGGTT |
| | | CCCGCGGGCCTGGCCTCTTTACGGGTTATGGCCCTTGCGTGCCT |
| | | TGAATTACTTCCACTGGCTGCAGTACGTGATTCTTGATCCCGAG |
| | | CTTCGGGTTGGAAGTGGGTGGGAGAGTTCGAGGCCTTGCGCTT |
| | | AAGGAGCCCCTTCGCCTCGTGCTTGAGTTGAGGCCTGGCCTGG |
| | | GCGCTGGGGCCGCCGCGTGCGAATCTGGTGGCACCTTCGCGCC |
| | | TGTCTCGCTGCTTTCGATAAGTCTCTAGCCATTTAAAATTTTTG |
| | | ATGACCTGCTGCGACGCTTTTTTTCTGGCAAGATAGTCTTGTAA |
| | | ATGCGGGCCAAGATCTGCACACTGGTATTTCGGTTTTTGGGGCC |
| | | GCGGGCGGCGACGGGGCCCGTGCGTCCCAGCGCACATGTTCGG |
| | | CGAGGCGGGGCCTGCGAGCGCGGCCACCGAGAATCGGACGGG |
| | | GGTAGTCTCAAGCTGGCCGGCCTGCTCTGGTGCCTGGCCTCGC |
| | | GCCGCCGTGTATCGCCCCGCCCTGGGCGGCAAGGCTGGCCCGG |
| | | TCGGCACCAGTTGCGTGAGCGGAAAGATGGCCGCTTCCCGGCC |
| | | CTGCTGCAGGGAGCTCAAAATGGAGGACGCGGCGCTCGGGAG |
| | | AGCGGGCGGGTGAGTCACCCACACAAAGGAAAAGGGCCTTTC |
| | | CGTCCTCAGCCGTCGCTTCATGTGACTCCACGGAGTACCGGGC |
| | | GCCGTCCAGGCACCTCGATTAGTTCTCGAGCTTTTGGAGTACGT |
| | | CGTCTTTAGGTTGGGGGAGGGGTTTTATGCGATGGAGTTTCCC |
| | | CACACTGAGTGGGTGGAGACTGAAGTTAGGCCAGCTTGGCACT |
| | | TGATGTAATTCTCCTTGGAATTTGCCCTTTTTGAGTTTGGATCTT |
| | | GGTTCATTCTCAAGCCTCAGACAGTGGTTCAAAGTTTTTTTCTT |
| | | CCATTTCAGGTGTCGTGACCACCATGGCTCTTCCTGTAACCGCA |
| | | CTTCTGCTTCCTCTTGCTCTGCTGCTTCATGCTGCTAGACCTCAG |
| | | GTGCAGTTACAACAGTCAGGAGGAGGATTAGTGCAGCCAGGA |
| | | GGATCTCTGAAACTGTCTTGTGCCGCCAGCGGAATCGATTTTAG |
| | | CAGGTACTGGATGTCTTGGGTGAGAAGAGCCCCTGGAAAAGGA |
| | | CTGGAGTGGATCGGCGAGATTAATCCTGATAGCAGCACCATCA |
| | | ACTATGCCCCTAGCCTGAAGGACAAGTTCATCATCAGCCGGGA |
| | | CAATGCCAAGAACACCCTGTACCTGCAAATGAGCAAGGTGAGG |
| | | AGCGAGGATACAGCTCTGTACTACTGTGCCAGCCTGTACTACG |
| | | ATTACGGAGATGCTATGGACTATTGGGCCAGGGAACAAGCGT |
| | | TACAGTGTCTTCTGGAGGAGGAGGATCCGGTGGTGGTGGTTCA |
| | | GGAGGTGGAGGTTCGGGAGATATTGTGATGACACAAAGCCAG |
| | | CGGTTCATGACCACATCTGTGGGCGACAGAGTGAGCGTGACCT |
| | | GTAAAGCTTCTCAGTCTGTGGACAGCAATGTTGCCTGGTATCA |
| | | GCAGAAGCCCAGACAGAGCCCTAAAGCCCTGATCTTTTCTGCC |
| | | AGCCTGAGATTTTCTGGCGTTCCTGCCAGATTTACCGGCTCTGG |
| | | CTCTGGCACCGATTTTACACTGACCATCAGCAATCTGCAGTCTG |
| | | AGGATCTGGCCGAGTACTTTTGCCAGCAGTACAACAACTACCC |
| | | CCTGACCTTTGGAGCTGGCACAAAACTGGAGCTGAAGAGTGCT |
| | | GCTGCCTTTGTCCCGGTATTTCTCCCAGCCAAACCGACCACGAC |
| | | TCCCGCCCCGCGCCCTCCGACACCCGCTCCCACCATCGCCTCTC |
| | | AACCTCTTAGTCTTCGCCCCGAGGCATGCCGACCCGCCGCCGG |
| | | GGGTGCTGTTCATACGAGGGGCTTGGACTTCGCTTGTGATATTT |
| | | ACATTTGGGCTCCGTTGGCGGGTACGTGCGCGCGTCCTTTTGTTG |
| | | TCACTCGTTATTACTTTGTATTGTAATCACAGGAATCGCTCAAA |

TABLE 34-continued rAAV Sequences

| SEQ ID NO: | Description | Sequence |
|---|---|---|
| | | GCGGAGTAGGTTGTTGCATTCCGATTACATGAATATGACTCCTC<br>GCCGGCCTGGGCCGACAAGAAAACATTACCAACCCTATGCCCC<br>CCCACGAGACTTCGCTGCGTACAGGTCCCGAGTGAAGTTTTCC<br>CGAAGCGCAGACGCTCCGGCATATCAGCAAGGACAGAATCAG<br>CTGTATAACGAACTGAATTTGGGACGCCGCGAGGAGTATGACG<br>TGCTTGATAAACGCCGGGGGAGAGACCCGGAAATGGGGGGTA<br>AACCCCGAAGAAAGAATCCCCAAGAAGGACTCTACAATGAAC<br>TCCAGAAGGATAAGATGGCGGAGGCCTACTCAGAAATAGGTAT<br>GAAGGGCGAACGACGACGGGGAAAAGGTCACGATGGCCTCTA<br>CCAAGGGTTGAGTACGGCAACCAAAGATACGTACGATGCACTG<br>CATATGCAGGCCCTGCCTCCCAGAGGAAGCGGAGCTACTAACT<br>TCAGCCTGCTGAAGCAGGCTGGAGACGTGGAGGAGAACCCTG<br>GACCTATGGTGAGCAAGGGCGAGGAGCTGTTCACCGGGGTGGT<br>GCCCATCCTGGTCGAGCTGGACGGCGACGTAAACGGCCACAAG<br>TTCAGCGTGTCCGGCGAGGGCGAGGGCGATGCCACCTACGGCA<br>AGCTGACCCTGAAGTTCATCTGCACCACCGGCAAGCTGCCCGT<br>GCCCTGGCCCACCCTCGTGACCACCCTGACCTACGGCGTGCAG<br>TGCTTCAGCCGCTACCCCGACCACATGAAGCAGCACGACTTCT<br>TCAAGTCCGCCATGCCCGAAGGCTACGTCCAGGAGCGCACCAT<br>CTTCTTCAAGGACGACGGCAACTACAAGACCCGCGCCGAGGTG<br>AAGTTCGAGGGCGACACCCTGGTGAACCGCATCGAGCTGAAGG<br>GCATCGACTTCAAGGAGGACGGCAACATCCTGGGGCACAAGCT<br>GGAGTACAACTACAACAGCCACAACGTCTATATCATGGCCGAC<br>AAGCAGAAGAACGGCATCAAGGTGAACTTCAAGATCCGCCAC<br>AACATCGAGGACGGCAGCGTGCAGCTCGCCGACCACTACCAGC<br>AGAACACCCCCATCGGCGACGGCCCCGTGCTGCTGCCCGACAA<br>CCACTACCTGAGCACCCAGTCCGCCCTGAGCAAAGACCCCAAC<br>GAGAAGCGCGATCACATGGTCCTGCTGGAGTTCGTGACCGCCG<br>CCGGGATCACTCTCGGCATGGACGAGCTGTACAAGTAATAATA<br>AAATAAAATCGCTATCCATCGAAGATGGATGTGTGTTGGTTTTT<br>TGTGTGTGGAGCAACAAATCTGACTTTGCATGTGCAAACGCCT<br>TCAACAACAGCATTATTCCAGAAGACACCTTCTTCCCCAGCCC<br>AGGTAAGGGCAGCTTTGGTGCCTTCGCAGGCTGTTTCCTTGCTT<br>CAGGAATGGCCAGGTTCTGCCCAGAGCTCTGGTCAATGATGTC<br>TAAAACTCCTCTGATTGGTGGTCTCGGCCTTATCCATTGCCACC<br>AAAACCCTCTTTTTACTAAGAAACAGTGAGCCTTGTTCTGGCAG<br>TCCAGAGAATGACACGGGAAAAAAGCAGATGAAGAGAAGGTG<br>GCAGGAGAGGGCACGTGGCCCAGCCTCAGTCTCTCCAACTGAG<br>TTCCTGCCTGCCTGCCTTTGCTCAGACTGTTTGCCCCTTACTGCT<br>CTTCTAGGCCTCATTCTAAGCCCCTTCTCCAAGTTGCCTCTCCTT<br>ATTTCTCCCTGTCTGCCAAAAAATCTTTCCCAGCTCACTAAGTC<br>AGTCTCACGCAGTCACTCATTAACCCGGTAACCACGTGCGGAC<br>CGAGGCTGCAGCGTCGTCCTCCCTAGGAACCCCTAGTGATGGA<br>GTTGGCCACTCCCTCTCTGCGCGCTCGCTCGCTCACTGAGGCCG<br>GGCGACCAAAGGTCGCCCGACGCCCGGGCTTTGCCCGGGCGGC<br>CTCAGTGAGCGAGCGAGCGCGCAGCTGCCTGCAGG |
| 1362 | CTX-153 | CCTGCAGGCAGCTGCGCGCTCGCTCGCTCACTGAGGCCGCCCG<br>GGCAAAGCCCGGGCGTCGGGCGACCTTTGGTCGCCCGGCCTCA<br>GTGAGCGAGCGAGCGCGCAGAGAGGGAGTGGCCAACTCCATC<br>ACTAGGGGTTCCTGCGGCCGCACGCGTGAGATGTAAGGAGCTG<br>CTGTGACTTGCTCAAGGCCTTATATCGAGTAAACGGTAGTGCT<br>GGGGCTTAGACGCAGGTGTTCTGATTTATAGTTCAAAACCTCTA<br>TCAATGAGAGAGCAATCTCCTGGTAATGTGATAGATTTCCCAA<br>CTTAATGCCAACATACCATAAACCTCCCATTCTGCTAATGCCCA<br>GCCTAAGTTGGGGAGACCACTCCAGATTCCAAGATGTACAGTT<br>TGCTTTGCTGGGCCTTTTTCCCATGCCTGCCTTTACTCTGCCAGA<br>GTTATATTGCTGGGGTTTTGAAGAAGATCCTATTAAATAAAAG<br>AATAAGCAGTATTATTAAGTAGCCCTGCATTTCAGGTTTCCTTG<br>AGTGGCAGGCCAGGCCTGGCCGTGAACGTTCACTGAAATCATG<br>GCCTCTTGGCCAAGATTGATAGCTTGTGCCTGTCCCTGAGTCCC<br>AGTCCATCACGAGCAGCTGGTTTCTAAGATGCTATTTCCCGTAT<br>AAAGCATGAGACCGTGACTTGCCAGCCCCACAGAGCCCCGCCC<br>TTGTCCATCACTGGCATCTGGACTCCAGCCTGGGTTGGGGCAA<br>AGAGGGAAATGAGATCATGTCCTAACCCTGATCCTCTTGTCCC<br>ACAGATATCCAGAACCCTGACCCTGCCGTGTACCAGCTGAGAG<br>ACTCTAAATCCAGTGACAAGTCTGTCTGCCTATTCACCGATTTT<br>GATTCTCAAACAAATGTGTCACAAAGTAAGGATTCTGATGTGT<br>ATATCACAGACAAAACTGTGCTAGACATGAGGTCTATGGACTT<br>CAGGCTCCGGTGCCCGTCAGTGGGCAGAGCGCACATCGCCCAC<br>AGTCCCCGAGAAGTTGGGGGGAGGGGTCGGCAATTGAACCGG<br>TGCCTAGAGAAGGTGGCGCGGGGTAAACTGGGAAAGTGATGT<br>CGTGTACTGGCTCCGCCTTTTTCCCGAGGGTGGGGGAGAACCG<br>TATATAAGTGCAGTAGTCGCCGTGAACGTTCTTTTTCGCAACGG<br>GTTTGCCGCCAGAACACAGGTAAGTGCCGTGTGTGGTTCCCGC<br>GGGCCTGGCCTCTTTACGGGTTATGGCCCTTGCGTGCCTTGAAT |

TABLE 34-continued rAAV Sequences

SEQ ID NO:Description Sequence

```
TACTTCCACTGGCTGCAGTACGTGATTCTTGATCCCGAGCTTCG
GGTTGGAAGTGGGTGGGAGAGTTCGAGGCCTTGCGCTTAAGGA
GCCCCTTCGCCTCGTGCTTGAGTTGAGGCCTGGCCTGGGCGCTG
GGGCCGCCGCGTGCGAATCTGGTGGCACCTTCGCGCCTGTCTC
GCTGCTTTCGATAAGTCTCTAGCCATTTAAAATTTTTGATGACC
TGCTGCGACGCTTTTTTTCTGGCAAGATAGTCTTGTAAATGCGG
GCCAAGATCTGCACACTGGTATTTCGGTTTTTGGGGCCGCGGG
CGGCGACGGGGCCCGTGCGTCCCAGCGCACATGTTCGGCGAGG
CGGGGCCTGCGAGCGCGGCCACCGAGAATCGGACGGGGGTAG
TCTCAAGCTGGCCGGCCTGCTCTGGTGCCTGGCCTCGCGCCGCC
GTGTATCGCCCCGCCCTGGGCGGCAAGGCTGGCCCGGTCGGCA
CCAGTTGCGTGAGCGGAAAGATGGCCGCTTCCCGGCCCTGCTG
CAGGGAGCTCAAAATGGAGGACGCGGCGCTCGGGAGAGCGGG
CGGGTGAGTCACCCACACAAAGGAAAAGGGCCTTTCCGTCCTC
AGCCGTCGCTTCATGTGACTCCACGGAGTACCGGGCGCCGTCC
AGGCACCTCGATTAGTTCTCGAGCTTTTGGAGTACGTCGTCTTT
AGGTTGGGGGGAGGGGTTTTATGCGATGGAGTTTCCCCACACT
GAGTGGGTGGAGACTGAAGTTAGGCCAGCTTGGCACTTGATGT
AATTCTCCTTGGAATTTGCCCTTTTTGAGTTTGGATCTTGGTTCA
TTCTCAAGCCTCAGACAGTGGTTCAAAGTTTTTTTCTTCCATTTC
AGGTGTCGTGACCACCATGGCTCTTCCTGTAACCGCACTTCTGC
TTCCTCTTGCTCTGCTGCTTCATGCTGCTAGACCTCAGGTGCAG
TTACAACAGTCAGGAGGAGGATTAGTGCAGCCAGGAGGATCTC
TGAAACTGTCTTGTGCCGCCAGCGGAATCGATTTTAGCAGGTA
CTGGATGTCTTGGGTGAGAAGAGCCCCTGGAAAAGGACTGGAG
TGGATCGGCGAGATTAATCCTGATAGCAGCACCATCAACTATG
CCCCTAGCCTGAAGGACAAGTTCATCATCAGCCGGGACAATGC
CAAGAACACCCTGTACCTGCAAATGAGCAAGGTGAGGAGCGA
GGATACAGCTCTGTACTACTGTGCCAGCCTGTACTACGATTACG
GAGATGCTATGGACTATTGGGGCCAGGGAACAAGCGTTACAGT
GTCTTCTGGAGGAGGAGGATCCGGTGGTGGTGGTTCAGGAGGT
GGAGGTTCGGGAGATATTGTGATGACACAAAGCCAGCGGTTCA
TGACCACATCTGTGGGCGACAGAGTGAGCGTGACCTGTAAAGC
TTCTCAGTCTGTGGACAGCAATGTTGCCTGGTATCAGCAGAAG
CCCAGACAGAGCCCTAAAGCCCTGATCTTTTCTGCCAGCCTGA
GATTTTCTGGCGTTCCTGCCAGATTTACCGGCTCTGGCTCTGGC
ACCGATTTTACACTGACCATCAGCAATCTGCAGTCTGAGGATCT
GGCCGAGTACTTTTGCCAGCAGTACAACAACTACCCCCTGACC
TTTGGAGCTGGCACAAAACTGGAGCTGAAGAGTGCTGCTGCCT
TTGTCCCGGTATTTCTCCCAGCCAAACCGACCACGACTCCCGCC
CCGCGCCCTCCGACACCCGCTCCCACCATCGCCTCTCAACCTCT
TAGTCTTCGCCCCGAGGCATGCCGACCCGCCGCCGGGGTGCT
GTTCATACGAGGGGCTTGGACTTCGCTTGTGATATTTACATTTG
GGCTCCGTTGGCGGGTACGTGCGGCGTCCTTTTGTTGTCACTCG
TTATTACTTTGTATTGTAATCACAGGAATCGCTCAAAGCGGAGT
AGGTTGTTGCATTCCGATTACATGAATATGACTCCTCGCCGGCC
TGGGCCGACAAGAAAACATTACCAACCCTATGCCCCCCCACGA
GACTTCGCTGCGTACAGGTCCCGAGTGAAGTTTTCCCGAAGCG
CAGACGCTCCGGCATATCAGCAAGGACAGAATCAGCTGTATAA
CGAACTGAATTTGGGACGCCGCGAGGAGTATGACGTGCTTGAT
AAACGCCGGGGAGAGACCCGGAAATGGGGGGTAAACCCCGA
AGAAAGAATCCCCAAGAAGGACTCTACAATGAACTCCAGAAG
GATAAGATGGCGGAGGCCTACTCAGAAATAGGTATGAAGGGC
GAACGACGACGGGGAAAAGGTCACGATGGCCTCTACCAAGGG
TTGAGTACGGCAACCAAAGATACGTACGATGCACTGCATATGC
AGGCCCTGCCTCCCAGATAATAATAAAATCGCTATCCATCGAA
GATGGATGTGTGTTGGTTTTTTGTGTGTGGAGCAACAAATCTGA
CTTTGCATGTGCAAACGCCTTCAACAACAGCATTATTCCAGAA
GACACCTTCTTCCCCAGCCCAGGTAAGGGCAGCTTTGGTGCCTT
CGCAGGCTGTTTCCTTGCTTCAGGAATGGCCAGGTTCTGCCCAG
AGCTCTGGTCAATGATGTCTAAAACTCCTCTGATTGGTGGTCTC
GGCCTTATCCATTGCCACCAAAACCCTCTTTTTACTAAGAAACA
GTGAGCCTTGTTCTGGCAGTCCAGAGAATGACACGGGAAAAA
GCAGATGAAGAGAAGGTGGCAGGAGAGGGCACGTGGCCCAGC
CTCAGTCTCTCCAACTGAGTTCCTGCCTGCCTGCCTTTGCTCAG
ACTGTTTGCCCCTTACTGCTCTTCTAGGCCTCATTCTAAGCCCCT
TCTCCAAGTTGCCTCTCCTTATTTCTCCCTGTCTGCCAAAAAAT
CTTTCCCAGCTCACTAAGTCAGTCTCACGCAGTCACTCATTAAC
CCACCAATCACTGATTGTGCCGGCACATGAATGCACCAGGTGT
TGAAGTGGAGGAATTAAAAAGTCAGATGAGGGGTGTGCCCAG
AGGAAGCACCATTCTAGTTGGGGGAGCCCATCTGTCAGCTGGG
AAAAGTCCAAATAACTTCAGATTGGAATGTGTTTTAACTCAGG
GTTGAGAAAACAGCTACCTTCAGGACAAAAGTCAGGGAAGGG
CTCTCTGAAGAAATGCTACTTGAAGATACCAGCCCTACCAAGG
GCAGGGAGAGGACCCTATAGAGGCCTGGGACAGGAGCTCAAT
GAGAAAGGTAACCACGTGCGGACCGAGGCTGCAGCGTCGTCCT
```

TABLE 34-continued rAAV Sequences

| SEQ ID NO: | Description | Sequence |
|---|---|---|
| | | CCCTAGGAACCCCTAGTGATGGAGTTGGCCACTCCCTCTCTGCG |
| | | CGCTCGCTCGCTCACTGAGGCCGGGCGACCAAAGGTCGCCCGA |
| | | CGCCCGGGCTTTGCCCGGGCGGCCTCAGTGAGCGAGCGAGCGC |
| | | GCAGCTGCCTGCAGG |
| 1363 | CTX-154 | CCTGCAGGCAGCTGCGCGCTCGCTCGCTCACTGAGGCCGCCCG |
| | | GGCAAAGCCCGGGCGTCGGGCGACCTTTGGTCGCCCGGCCTCA |
| | | GTGAGCGAGCGAGCGCGCAGAGAGGGAGTGGCCAACTCCATC |
| | | ACTAGGGGTTCCTGCGGCCGCACGCGTGAAGATCCTATTAAAT |
| | | AAAAGAATAAGCAGTATTATTAAGTAGCCCTGCATTTCAGGTT |
| | | TCCTTGAGTGGCAGGCCAGGCCTGGCCGTGAACGTTCACTGAA |
| | | ATCATGGCCTCTTGGCCAAGATTGATAGCTTGTGCCTGTCCCTG |
| | | AGTCCCAGTCCATCACGAGCAGCTGGTTTCTAAGATGCTATTTC |
| | | CCGTATAAAGCATGAGACCGTGACTTGCCAGCCCCACAGAGCC |
| | | CCGCCCTTGTCCATCACTGGCATCTGGACTCCAGCCTGGGTTGG |
| | | GGCAAAGAGGGAAATGAGATCATGTCCTAACCCTGATCCTCTT |
| | | GTCCCACAGATATCCAGAACCCTGACCCTGCCGTGTACCAGCT |
| | | GAGAGACTCTAAATCCAGTGACAAGTCTGTCTGCCTATTCACC |
| | | GATTTTGATTCTCAAACAAATGTGTCACAAAGTAAGGATTCTG |
| | | ATGTGTATATCACAGACAAAACTGTGCTAGACATGAGGTCTAT |
| | | GGACTTCAGGCTCCGGTGCCCGTCAGTGGGCAGAGCGCACATC |
| | | GCCCACAGTCCCCGAGAAGTTGGGGGGAGGGGTCGGCAATTG |
| | | AACCGGTGCCTAGAGAAGGTGGCGCGGGGTAAACTGGGAAAG |
| | | TGATGTCGTGTACTGGCTCCGCCTTTTTCCCGAGGGTGGGGGAG |
| | | AACCGTATATAAGTGCAGTAGTCGCCGTGAACGTTCTTTTTCGC |
| | | AACGGGTTTGCCGCCAGAACACAGGTAAGTGCCGTGTGTGGTT |
| | | CCCGCGGGCCTGGCCTCTTTACGGGTTATGGCCCTTGCGTGCCT |
| | | TGAATTACTTCCACTGGCTGCAGTACGTGATTCTTGATCCCGAG |
| | | CTTCGGGTTGGAAGTGGGTGGGAGAGTTCGAGGCCTTGCGCTT |
| | | AAGGAGCCCCTTCGCCTCGTGCTTGAGTTGAGGCCTGGCCTGG |
| | | GCGCTGGGGCCGCCGCGTGCGAATCTGGTGGCACCTTCGCGCC |
| | | TGTCTCGCTGCTTTCGATAAGTCTCTAGCCATTTAAAATTTTTG |
| | | ATGACCTGCTGCGACGCTTTTTTTCTGGCAAGATAGTCTTGTAA |
| | | ATGCGGGCCAAGATCTGCACACTGGTATTTCGGTTTTTGGGGCC |
| | | GCGGGCGGCGACGGGGCCCGTGCGTCCCAGCGCACATGTTCGG |
| | | CGAGGCGGGGCCTGCGAGCGCGGCCACCGAGAATCGGACGGG |
| | | GGTAGTCTCAAGCTGGCCGGCCTGCTCTGGTGCCTGGCCTCGC |
| | | GCCGCCGTGTATCGCCCCGCCCTGGGCGGCAAGGCTGGCCCGG |
| | | TCGGCACCAGTTGCGTGAGCGGAAAGATGGCCGCTTCCCGGCC |
| | | CTGCTGCAGGGAGCTCAAAATGGAGGACGCGGCGCTCGGGAG |
| | | AGCGGGCGGGTGAGTCACCCACACAAAGGAAAAGGGCCTTTC |
| | | CGTCCTCAGCCGTCGCTTCATGTGACTCCACGGAGTACCGGGC |
| | | GCCGTCCAGGCACCTCGATTAGTTCTCGAGCTTTTGGAGTACGT |
| | | CGTCTTTAGGTTGGGGGAGGGGTTTTATGCGATGGAGTTTCCC |
| | | CACACTGAGTGGGTGGAGACTGAAGTTAGGCCAGCTTGGCACT |
| | | TGATGTAATTCTCCTTGGAATTTGCCCTTTTTGAGTTTGGATCTT |
| | | GGTTCATTCTCAAGCCTCAGACAGTGGTTCAAAGTTTTTTTCTT |
| | | CCATTTCAGGTGTCGTGACCACCATGGCTCTTCCTGTAACCGCA |
| | | CTTCTGCTTCCTCTTGCTCTGCTGCTTCATGCTGCTAGACCTGAC |
| | | ATCGTGATGACCCAAAGCCAGAGGTTCATGACCACATCTGTGG |
| | | GCGATAGAGTGAGCGTGACCTGTAAAGCCTCTCAGTCTGTGGA |
| | | CAGCAATGTTGCCTGGTATCAGCAGAAGCCTAGACAGAGCCCT |
| | | AAAGCCCTGATCTTTAGCGCCAGCCTGAGATTTAGCGGAGTTC |
| | | CTGCCAGATTTACCGGAAGCGGATCTGGAACCGATTTTACACT |
| | | GACCATCAGCAACCTGCAGAGCGAGGATCTGGCCGAGTACTTT |
| | | TGCCAGCAGTACAACAATTACCCTCTGACCTTTGGAGCCGGCA |
| | | CAAAGCTGGAGCTGAAAGGAGGAGGAGGATCTGGTGGTGGTG |
| | | GTTCAGGAGGTGGAGGTTCGGGACAAGTTCAATTACAGCAATC |
| | | TGGAGGAGGACTGGTTCAGCCTGGAGGAAGCCTGAAGCTGTCT |
| | | TGTGCCGCTTCTGGAATCGATTTTAGCAGATACTGGATGAGCTG |
| | | GGTGAGAAGAGCCCCTGGCAAAGGACTGGAGTGGATTGGCGA |
| | | GATTAATCCTGATAGCAGCACCATCAACTATGCCCCTAGCCTG |
| | | AAGGACAAGTTCATCATCAGCCGGGACAATGCCAAGAACACCC |
| | | TGTACCTGCAAATGAGCAAGGTGAGGAGCGAGGATACAGCTCT |
| | | GTACTACTGTGCCAGCCTGTACTACGATTACGGAGATGCTATG |
| | | GACTATTGGGCCAGGGAACAAGCGTTACAGTGAGCAGCAGT |
| | | GCTGCTGCCTTTGTCCCGGTATTTCTCCCAGCCAAACCGACCAC |
| | | GACTCCCGCCCCGCGCCCTCCGACACCCGCTCCCACCATCGCCT |
| | | CTCAACCTCTTAGTCTTCGCCCCGAGGCATGCCGACCCGCCGCC |
| | | GGGGGTGCTGTTCATACGAGGGGCTTGGACTTCGCTTGTGATA |
| | | TTTACATTTGGGCTCCGTTGGCGGGTACGTGCGGCGTCCTTTTG |
| | | TTGTCACTCGTTATTACTTTGTATTGTAATCACAGGAATCGCTC |
| | | AAAGCGGAGTAGGTTGTTGCATTCCGATTACATGAATATGACT |
| | | CCTCGCCGGCCTGGGCCGACAAGAAAACATTACCAACCCTATG |
| | | CCCCCCCACGAGACTTCGCTGCGTACAGGTCCCGAGTGAAGTT |
| | | TTCCCGAAGCGCAGACGCTCCGGCATATCAGCAAGGACAGAAT |

TABLE 34-continued rAAV Sequences

| SEQ ID NO: | Description | Sequence |
|---|---|---|
| | | CAGCTGTATAACGAACTGAATTTGGGACGCCGCGAGGAGTATG |
| | | ACGTGCTTGATAAACGCCGGGGGAGAGACCCGGAAATGGGGG |
| | | GTAAACCCCGAAGAAAGAATCCCCAAGAAGGACTCTACAATG |
| | | AACTCCAGAAGGATAAGATGGCGGAGGCCTACTCAGAAATAG |
| | | GTATGAAGGGCGAACGACGACGGGGAAAAGGTCACGATGGCC |
| | | TCTACCAAGGGTTGAGTACGGCAACCAAAGATACGTACGATGC |
| | | ACTGCATATGCAGGCCCTGCCTCCCAGAGGAAGCGGAGCTACT |
| | | AACTTCAGCCTGCTGAAGCAGGCTGGAGACGTGGAGGAGAAC |
| | | CCTGGACCTATGGTGAGCAAGGGCGAGGAGCTGTTCACCGGGG |
| | | TGGTGCCCATCCTGGTCGAGCTGGACGGCGACGTAAACGGCCA |
| | | CAAGTTCAGCGTGTCCGGCGAGGGCGAGGGCGATGCCACCTAC |
| | | GGCAAGCTGACCCTGAAGTTCATCTGCACCACCGGCAAGCTGC |
| | | CCGTGCCCTGGCCCACCCTCGTGACCACCCTGACCTACGGCGT |
| | | GCAGTGCTTCAGCCGCTACCCCGACCACATGAAGCAGCACGAC |
| | | TTCTTCAAGTCCGCCATGCCCGAAGGCTACGTCCAGGAGCGCA |
| | | CCATCTTCTTCAAGGACGACGGCAACTACAAGACCCGCGCCGA |
| | | GGTGAAGTTCGAGGGCGACACCCTGGTGAACCGCATCGAGCTG |
| | | AAGGGCATCGACTTCAAGGAGGACGGCAACATCCTGGGGCAC |
| | | AAGCTGGAGTACAACTACAACAGCCACAACGTCTATATCATGG |
| | | CCGACAAGCAGAAGAACGGCATCAAGGTGAACTTCAAGATCC |
| | | GCCACAACATCGAGGACGGCAGCGTGCAGCTCGCCGACCACTA |
| | | CCAGCAGAACACCCCCATCGGCGACGGCCCCGTGCTGCTGCCC |
| | | GACAACCACTACCTGAGCACCCAGTCCGCCCTGAGCAAAGACC |
| | | CCAACGAGAAGCGCGATCACATGGTCCTGCTGGAGTTCGTGAC |
| | | CGCCGCCGGGATCACTCTCGGCATGGACGAGCTGTACAAGTAA |
| | | TAATAAAATAAAATCGCTATCCATCGAAGATGGATGTGTGTTG |
| | | GTTTTTTGTGTGTGGAGCAACAAATCTGACTTTGCATGTGCAAA |
| | | CGCCTTCAACAACAGCATTATTCCAGAAGACACCTTCTTCCCCA |
| | | GCCCAGGTAAGGGCAGCTTTGGTGCCTTCGCAGGCTGTTTCCTT |
| | | GCTTCAGGAATGGCCAGGTTCTGCCCAGAGCTCTGGTCAATGA |
| | | TGTCTAAAACTCCTCTGATTGGTGGTCTCGGCCTTATCCATTGC |
| | | CACCAAAACCCTCTTTTTACTAAGAAACAGTGAGCCTTGTTCTG |
| | | GCAGTCCAGAGAATGACACGGGAAAAAAGCAGATGAAGAGAA |
| | | GGTGGCAGGAGAGGGCACGTGGCCCAGCCTCAGTCTCTCCAAC |
| | | TGAGTTCCTGCCTGCCTGCCTTTGCTCAGACTGTTTGCCCCTTA |
| | | CTGCTCTTCTAGGCCTCATTCTAAGCCCCTTCTCCAAGTTGCCT |
| | | CTCCTTATTTCTCCCTGTCTGCCAAAAAATCTTTCCCAGCTCACT |
| | | AAGTCAGTCTCACGCAGTCACTCATTAACCCGGTAACCACGTG |
| | | CGGACCGAGGCTGCAGCGTCGTCCTCCCTAGGAACCCCTAGTG |
| | | ATGGAGTTGGCCACTCCCTCTGCGCGCTCGCTCGCTCACTGA |
| | | GGCCGGGCGACCAAAGGTCGCCCGACGCCCGGGCTTTGCCCGG |
| | | GCGGCCTCAGTGAGCGAGCGAGCGCGCAGCTGCCTGCAGG |
| 1364 | CTX-155 | CCTGCAGGCAGCTGCGCGCTCGCTCGCTCACTGAGGCCGCCCG |
| | | GGCAAAGCCCGGGCGTCGGGCGACCTTTGGTCGCCCGGCCTCA |
| | | GTGAGCGAGCGAGCGCGCAGAGAGGGAGTGGCCAACTCCATC |
| | | ACTAGGGGTTCCTGCGGCCGCACGCGTGAGATGTAAGGAGCTG |
| | | CTGTGACTTGCTCAAGGCCTTATATCGAGTAAACGGTAGTGCT |
| | | GGGGCTTAGACGCAGGTGTTCTGATTTATAGTTCAAAACCTCTA |
| | | TCAATGAGAGAGCAATCTCCTGGTAATGTGATAGATTTCCCAA |
| | | CTTAATGCCAACATACCATAAACCTCCCATTCTGCTAATGCCCA |
| | | GCCTAAGTTGGGGAGACCACTCCAGATTCCAAGATGTACAGTT |
| | | TGCTTTGCTGGGCCTTTTTCCCATGCCTGCCTTTACTCTGCCAGA |
| | | GTTATATTGCTGGGGTTTTGAAGAAGATCCTATTAAATAAAAG |
| | | AATAAGCAGTATTATTAAGTAGCCCTGCATTTCAGGTTTCCTTG |
| | | AGTGGCAGGCCAGGCCTGGCCGTGAACGTTCACTGAAATCATG |
| | | GCCTCTTGGCCAAGATTGATAGCTTGTGCCTGTCCCTGAGTCCC |
| | | AGTCCATCACGAGCAGCTGGTTTCTAAGATGCTATTTCCCGTAT |
| | | AAAGCATGAGACCGTGACTTGCCAGCCCCACAGAGCCCCGCCC |
| | | TTGTCCATCACTGGCATCTGGACTCCAGCCTGGGTTGGGGCAA |
| | | AGAGGGAAATGAGATCATGTCCTAACCCTGATCCTCTTGTCCC |
| | | ACAGATATCCAGAACCCTGACCCTGCCGTGTACCAGCTGAGAG |
| | | ACTCTAAATCCAGTGACAAGTCTGTCTGCCTATTCACCGATTTT |
| | | GATTCTCAAACAAATGTGTCACAAAGTAAGGATTCTGATGTGT |
| | | ATATCACAGACAAAACTGTGCTAGACATGAGGTCTATGGACTT |
| | | CAGGCTCCGGTGCCCGTCAGTGGGCAGAGCGCACATCGCCCAC |
| | | AGTCCCCGAGAAGTTGGGGGAGGGGTCGGCAATTGAACCGG |
| | | TGCCTAGAGAAGGTGGCGCGGGGTAAACTGGGAAAGTGATGT |
| | | CGTGTACTGGCTCCGCCTTTTTCCCGAGGGTGGGGGAGAACCG |
| | | TATATAAGTGCAGTAGTCGCCGTGAACGTTCTTTTTCGCAACGG |
| | | GTTTGCCGCCAGAACACAGGTAAGTGCCGTGTGTGGTTCCGC |
| | | GGGCCTGGCCTCTTTACGGGTTATGGCCCTTGCGTGCCTTGAAT |
| | | TACTTCCACTGGCTGCAGTACGTGATTCTTGATCCCGAGCTTCG |
| | | GGTTGGAAGTGGGTGGGAGAGTTCGAGGCCTTGCGCTTAAGGA |
| | | GCCCCTTCGCCTCGTGCTTGAGTTGAGGCCTGGCCTGGGCGCTG |
| | | GGGCCGCCGCGTGCGAATCTGGTGGCACCTTCGCGCCTGTCTC |

TABLE 34-continued rAAV Sequences

| SEQ ID NO: | Description | Sequence |
|---|---|---|
| | | GCTGCTTTCGATAAGTCTCTAGCCATTTAAAATTTTTGATGACC
TGCTGCGACGCTTTTTTTCTGGCAAGATAGTCTTGTAAATGCGG
GCCAAGATCTGCACACTGGTATTTCGGTTTTTGGGGCCGCGGG
CGGCGACGGGGCCCGTGCGTCCCAGCGCACATGTTCGGCGAGG
CGGGGCCTGCGAGCGCGGCCACCGAGAATCGGACGGGGGTAG
TCTCAAGCTGGCCGGCCTGCTCTGGTGCCTGGCCTCGCGCCGCC
GTGTATCGCCCCGCCCTGGGCGGCAAGGCTGGCCCGGTCGGCA
CCAGTTGCGTGAGCGGAAAGATGGCCGCTTCCCGGCCCTGCTG
CAGGGAGCTCAAAATGGAGGACGCGGCGCTCGGGAGAGCGGG
CGGGTGAGTCACCCACACAAAGGAAAAGGGCCTTTCCGTCCTC
AGCCGTCGCTTCATGTGACTCCACGGAGTACCGGGCGCCGTCC
AGGCACCTCGATTAGTTCTCGAGCTTTTGGAGTACGTCGTCTTT
AGGTTGGGGGGAGGGGTTTTATGCGATGGAGTTTCCCCACACT
GAGTGGGTGGAGACTGAAGTTAGGCCAGCTTGGCACTTGATGT
AATTCTCCTTGGAATTTGCCCTTTTTGAGTTTGGATCTTGGTTCA
TTCTCAAGCCTCAGACAGTGGTTCAAAGTTTTTTTCTTCCATTTC
AGGTGTCGTGACCACCATGGCTCTTCCTGTAACCGCACTTCTGC
TTCCTCTTGCTCTGCTGCTTCATGCTGCTAGACCTGACATCGTG
ATGACCCAAAGCCAGAGGTTCATGACCACATCTGTGGGCGATA
GAGTGAGCGTGACCTGTAAAGCCTCTCAGTCTGTGGACAGCAA
TGTTGCCTGGTATCAGCAGAAGCCTAGACAGAGCCCTAAAGCC
CTGATCTTTAGCGCCAGCCTGAGATTTAGCGGAGTTCCTGCCAG
ATTTACCGGAAGCGGATCTGGAACCGATTTTACACTGACCATC
AGCAACCTGCAGAGCGAGGATCTGGCCGAGTACTTTTGCCAGC
AGTACAACAATTACCCTCTGACCTTTGGAGCCGGCACAAAGCT
GGAGCTGAAAGGAGGAGGAGGATCTGGTGGTGGTGGTTCAGG
AGGTGGAGGTTCGGGACAAGTTCAATTACAGCAATCTGGAGGA
GGACTGGTTCAGCCTGGAGGAAGCCTGAAGCTGTCTTGTGCCG
CTTCTGGAATCGATTTTAGCAGATACTGGATGAGCTGGGTGAG
AAGAGCCCCTGGCAAAGGACTGGAGTGGATTGGCGAGATTAAT
CCTGATAGCAGCACCATCAACTATGCCCCTAGCCTGAAGGACA
AGTTCATCATCAGCCGGGACAATGCCAAGAACACCCTGTACCT
GCAAATGAGCAAGGTGAGGAGCGAGGATACAGCTCTGTACTA
CTGTGCCAGCCTGTACTACGATTACGGGAGATGCTATGGACTATT
GGGGCCAGGGAACAAGCGTTACAGTGAGCAGCAGTGCTGCTG
CCTTTGTCCCGGTATTTCTCCCAGCCAAACCGACCACGACTCCC
GCCCCGCGCCCTCCGACACCCGCTCCCACCATCGCCTCTCAACC
TCTTAGTCTTCGCCCCGAGGCATGCCGACCCGCCGCCGGGGT
GCTGTTCATACGAGGGGCTTGGACTTCGCTTGTGATATTTACAT
TTGGGCTCCGTTGGCGGGTACGTGCGGCGTCCTTTTGTTGTCAC
TCGTTATTACTTTGTATTGTAATCACAGGAATCGCTCAAAGCGG
AGTAGGTTGTTGCATTCCGATTACATGAATATGACTCCTCGCCG
GCCTGGGCCGACAAGAAAACATTACCAACCCTATGCCCCCCCA
CGAGACTTCGCTGCGTACAGGTCCCGAGTGAAGTTTTCCCGAA
GCGCAGACGCTCCGGCATATCAGCAAGGACAGAATCAGCTGTA
TAACGAACTGAATTTGGGACGCCGCGAGGAGTATGACGTGCTT
GATAAACGCCGGGGAGAGACCCGGAAATGGGGGGTAAACCC
CGAAGAAAGAATCCCCAAGAAGGACTCTACAATGAACTCCAG
AAGGATAAGATGGCGGAGGCCTACTCAGAAATAGGTATGAAG
GGCGAACGACGACGGGGAAAAGGTCACGATGGCCTCTACCAA
GGGTTGAGTACGGCAACCAAAGATACGTACGATGCACTGCATA
TGCAGGCCCTGCCTCCCAGATAATAATAAAATCGCTATCCATC
GAAGATGGATGTGTGTTGGTTTTTTGTGTGTGGAGCAACAAATC
TGACTTTGCATGTGCAAACGCCTTCAACAACAGCATTATTCCAG
AAGACACCTTCTTCCCCAGCCCAGGTAAGGGCAGCTTTGGTGC
CTTCGCAGGCTGTTTCCTTGCTTCAGGAATGGCCAGGTTCTGCC
CAGAGCTCTGGTCAATGATGTCTAAAACTCCTCTGATTGGTGGT
CTCGGCCTTATCCATTGCCACCAAAACCCTCTTTTTACTAAGAA
ACAGTGAGCCTTGTTCTGGCAGTCCAGAGAATGACACGGGAAA
AAAGCAGATGAAGAGAAGGTGGCAGGAGAGGGCACGTGGCCC
AGCCTCAGTCTCTCCAACTGAGTTCCTGCCTGCCTGCCTTTGCT
CAGACTGTTTGCCCCTTACTGCTCTTCTAGGCCTCATTCTAAGC
CCCTTCTCCAAGTTGCCTCTCCTTATTTCTCCCTGTCTGCCAAAA
AATCTTTCCCAGCTCACTAAGTCAGTCTCACGCAGTCACTCATT
AACCCACCAATCACTGATTGTGCCGGCACATGAATGCACCAGG
TGTTGAAGTGGAGGAATTAAAAAGTCAGATGAGGGGTGTGCCC
AGAGGAAGCACCATTCTAGTTGGGGGAGCCCATCTGTCAGCTG
GGAAAAGTCCAAATAACTTCAGATTGGAATGTGTTTTAACTCA
GGGTTGAGAAAACAGCTACCTTCAGGACAAAAGTCAGGGAAG
GGCTCTCTGAAGAAATGCTACTTGAAGATACCAGCCCTACCAA
GGGCAGGGAGAGGACCCTATAGAGGCCTGGGACAGGAGCTCA
ATGAGAAAGGTAACCACGTGCGGACCGAGGCTGCAGCGTCGTC
CTCCCTAGGAACCCCTAGTGATGGAGTTGGCCACTCCCTCTCTG
CGCGCTCGCTCGCTCACTGAGGCCGGGCGACCAAAGGTCGCCC
GACGCCCGGGCTTTGCCCGGGCGGCCTCAGTGAGCGAGCGAGC
GCGCAGCTGCCTGCAGG |

TABLE 34-continued rAAV Sequences

| SEQ ID NO: | Description | Sequence |
|---|---|---|
| 1365 | CTX-160 | CCTGCAGGCAGCTGCGCGCTCGCTCGCTCACTGAGGCCGCCCG<br>GGCGTCGGGCGACCTTTGGTCGCCCGGCCTCAGTGAGCGAGCG<br>AGCGCGCAGAGAGGGAGTGGCCAACTCCATCACTAGGGGTTCC<br>TGCGGCCGCACGCGTGAGATGTAAGGAGCTGCTGTGACTTGCT<br>CAAGGCCTTATATCGAGTAAACGGTAGTGCTGGGGCTTAGACG<br>CAGGTGTTCTGATTTATAGTTCAAAACCTCTATCAATGAGAGA<br>GCAATCTCCTGGTAATGTGATAGATTTCCCAACTTAATGCCAAC<br>ATACCATAAACCTCCCATTCTGCTAATGCCCAGCCTAAGTTGGG<br>GAGACCACTCCAGATTCCAAGATGTACAGTTTGCTTTGCTGGG<br>CCTTTTTCCCATGCCTGCCTTTACTCTGCCAGAGTTATATTGCTG<br>GGGTTTTGAAGAAGATCCTATTAAATAAAAGAATAAGCAGTAT<br>TATTAAGTAGCCCTGCATTTCAGGTTTCCTTGAGTGGCAGGCCA<br>GGCCTGGCCGTGAACGTTCACTGAAATCATGGCCTCTTGGCCA<br>AGATTGATAGCTTGTGCCTGTCCCTGAGTCCCAGTCCATCACGA<br>GCAGCTGGTTTCTAAGATGCTATTTCCCGTATAAAGCATGAGA<br>CCGTGACTTGCCAGCCCCACAGAGCCCCGCCCTTGTCCATCACT<br>GGCATCTGGACTCCAGCCTGGGTTGGGGCAAAGAGGGAAATG<br>AGATCATGTCCTAACCCTGATCCTCTTGTCCCACAGATATCCAG<br>AACCCTGACCCTGCCGTGTACCAGCTGAGAGACTCTAAATCCA<br>GTGACAAGTCTGTCTGCCTATTCACCGATTTTGATTCTCAAACA<br>AATGTGTCACAAAGTAAGGATTCTGATGTGTATATCACAGACA<br>AAACTGTGCTAGACATGAGGTCTATGGACTTCAGGCTCCGGTG<br>CCCGTCAGTGGGCAGAGCGCACATCGCCCACAGTCCCCGAGAA<br>GTTGGGGGGAGGGGTCGGCAATTGAACCGGTGCCTAGAGAAG<br>GTGGCGCGGGGTAAACTGGGAAAGTGATGTCGTGTACTGGCTC<br>CGCCTTTTTCCCGAGGGTGGGGGAGAACCGTATATAAGTGCAG<br>TAGTCGCCGTGAACGTTCTTTTTCGCAACGGGTTTGCCGCCAGA<br>ACACAGGTAAGTGCCGTGTGTGGTTCCCGCGGGCCTGGCCTCT<br>TTACGGGTTATGGCCCTTGCGTGCCTTGAATTACTTCCACTGGC<br>TGCAGTACGTGATTCTTGATCCCGAGCTTCGGGTTGGAAGTGG<br>GTGGGAGAGTTCGAGGCCTTGCGCTTAAGGAGCCCCTTCGCCT<br>CGTGCTTGAGTTGAGGCCTGGCCTGGGCGCTGGGGCCGCCGCG<br>TGCGAATCTGGTGGCACCTTCGCGCCTGTCTCGCTGCTTTCGAT<br>AAGTCTCTAGCCATTTAAAATTTTTGATGACCTGCTGCGACGCT<br>TTTTTTCTGGCAAGATAGTCTTGTAAATGCGGGCCAAGATCTGC<br>ACACTGGTATTTCGGTTTTTGGGGCCGCGGGCGGCGACGGGGC<br>CCGTGCGTCCCAGCGCACATGTTCGGCGAGGCGGGGCCTGCGA<br>GCGCGGCCACCGAGAATCGGACGGGGGTAGTCTCAAGCTGGCC<br>GGCCTGCTCTGGTGCCTGGCCTCGCGCCGCCGTGTATCGCCCCG<br>CCCTGGGCGGCAAGGCTGGCCCGGTCGGCACCAGTTGCGTGAG<br>CGGAAAGATGGCCGCTTCCCGGCCCTGCTGCAGGGAGCTCAAA<br>ATGGAGGACGCGGCGCTCGGGAGAGCGGGCGGGTGAGTCACC<br>CACACAAAGGAAAAGGGCCTTTCCGTCCTCAGCCGTCGCTTCA<br>TGTGACTCCACGGAGTACCGGGCGCCGTCCAGGCACCTCGATT<br>AGTTCTCGAGCTTTTGGAGTACGTCGTCTTTAGGTTGGGGGGAG<br>GGGTTTTATGCGATGGAGTTTCCCCACACTGAGTGGGTGGAGA<br>CTGAAGTTAGGCCAGCTTGGCACTTGATGTAATTCTCCTTGGAA<br>TTTGCCCTTTTTGAGTTTGGATCTTGGTTCATTCTCAAGCCTCAG<br>ACAGTGGTTCAAAGTTTTTTTCTTCATTTCAGGTGTCGTGACC<br>ACCATGGCGCTTCCGGTGACAGCACTGCTCCTCCCCTTGGCGCT<br>GTTGCTCCACGCAGCAAGGCCGGAGGTCCAGCTGGTGGAGAGC<br>GGCGGAGGACTGGTCCAGCCTGGCGGCTCCCTGAAACTGAGCT<br>GCGCCGCCAGCGGCATCGACTTCAGCAGGTACTGGATGAGCTG<br>GGTGAGACAGGCCCCTGGCAAGGGCCTGGAATGGATCGGCGA<br>GATCAACCCCGACTCCAGCACCATCAACTACGCCGACAGCGTC<br>AAGGGCAGGTTCACCATTAGCAGGGACAATGCCAAGAACACC<br>CTGTACCTGCAGATGAACCTGAGCAGGGCCGAAGACACCGCCC<br>TGTACTACTGTGCCAGCCTGTACTACGACTATGGCGACGCTATG<br>GACTACTGGGGCCAGGGCACCCTGGTGACAGTGAGCTCCGGAG<br>GAGGCGGCAGCGGCGGAGGCGGCAGCGGCGGAGGCGGCAGCG<br>ACATCCAGATGACCCAGAGCCCTAGCAGCCTGAGCGCCTCCGT<br>GGGAGATAGGGTGACAATCACCTGTAGGGCCAGCCAGAGCGT<br>GGACTCCAACGTGGCCTGGTATCAACAGAAGCCCGAGAAGGCC<br>CCCAAGAGCCTGATCTTTTCCGCCTCCCTGAGGTTCAGCGGAGT<br>CCCCAGCAGGTTCTCCGGATCCGGCTCCGGAACCGACTTTACC<br>CTGACCATCTCCAGCCTGCAGCCCGAGGACTTCGCCACCTACT<br>ACTGCCAGCAGTACAACAGCTACCCCCTGACCTTCGGCGCCGG<br>CACAAAGCTGGAGATCAAGAGTGCTGCTGCCTTTGTCCCGGTA<br>TTTCTCCCAGCCAAACCGACCACGACTCCCGCCCCGCGCCCTCC<br>GACACCCGCTCCCACCATCGCCTCTCAACCTCTTAGTCTTCGCC<br>CCGAGGCATGCCGACCCGCCGCCGGGGGTGCTGTTCATACGAG<br>GGGCTTGGACTTCGCTTGTGATATTTACATTTGGGCTCCGTTGG<br>CGGGTACGTGCGGCGTCCTTTTGTTGTCACTCGTTATTACTTTG<br>TATTGTAATCACAGGAATCGCTCAAAGCGGAGTAGGTTGTTGC<br>ATTCCGATTACATGAATATGACTCCTCGCCGGCCTGGGCCGAC |

TABLE 34-continued rAAV Sequences

| SEQ ID NO: | Description | Sequence |
|---|---|---|
| | | AAGAAAACATTACCAACCCTATGCCCCCCCACGAGACTTCGCT
GCGTACAGGTCCCGAGTGAAGTTTTCCCGAAGCGCAGACGCTC
CGGCATATCAGCAAGGACAGAATCAGCTGTATAACGAACTGAA
TTTGGGACGCCGCGAGGAGTATGACGTGCTTGATAAACGCCGG
GGGAGAGACCCGGAAATGGGGGGTAAACCCCGAAGAAAGAAT
CCCCAAGAAGGACTCTACAATGAACTCCAGAAGGATAAGATG
GCGGAGGCCTACTCAGAAATAGGTATGAAGGGCGAACGACGA
CGGGGAAAAGGTCACGATGGCCTCTACCAAGGGTTGAGTACGG
CAACCAAAGATACGTACGATGCACTGCATATGCAGGCCCTGCC
TCCCAGATAATAATAAAATCGCTATCCATCGAAGATGGATGTG
TGTTGGTTTTTTGTGTGTGGAGCAACAAATCTGACTTTGCATGT
GCAAACGCCTTCAACAACAGCATTATTCCAGAAGACACCTTCT
TCCCCAGCCCAGGTAAGGGCAGCTTTGGTGCCTTCGCAGGCTG
TTTCCTTGCTTCAGGAATGGCCAGGTTCTGCCCAGAGCTCTGGT
CAATGATGTCTAAAACTCCTCTGATTGGTGGTCTCGGCCTTATC
CATTGCCACCAAAACCCTCTTTTTACTAAGAAACAGTGAGCCTT
GTTCTGGCAGTCCAGAGAATGACACGGGAAAAAAGCAGATGA
AGAGAAGGTGGCAGGAGAGGGCACGTGGCCCAGCCTCAGTCT
CTCCAACTGAGTTCCTGCCTGCCTGCCTTTGCTCAGACTGTTTG
CCCCTTACTGCTCTTCTAGGCCTCATTCTAAGCCCCTTCTCCAA
GTTGCCTCTCCTTATTTCTCCCTGTCTGCCAAAAAATCTTTCCCA
GCTCACTAAGTCAGTCTCACGCAGTCACTCATTAACCCACCAAT
CACTGATTGTGCCGGCACATGAATGCACCAGGTGTTGAAGTGG
AGGAATTAAAAAGTCAGATGAGGGGTGTGCCCAGAGGAAGCA
CCATTCTAGTTGGGGAGCCCATCTGTCAGCTGGGAAAAGTCC
AAATAACTTCAGATTGGAATGTGTTTTAACTCAGGGTTGAGAA
AACAGCTACCTTCAGGACAAAAGTCAGGGAAGGGCTCTCTGAA
GAAATGCTACTTGAAGATACCAGCCCTACCAAGGGCAGGGAG
AGGACCCTATAGAGGCCTGGGACAGGAGCTCAATGAGAAAGG
TAACCACGTGCGGACCGAGGCTGCAGCGTCGTCCTCCCTAGGA
ACCCCTAGTGATGGAGTTGGCCACTCCCTCTCTGCGCGCTCGCT
CGCTCACTGAGGCCGGGCGACCAAAGGTCGCCCGACGCCCGGG
CTTTGCCCGGGCGGCCTCAGTGAGCGAGCGAGCGCGCAGCTGC
CTGCAGG |
| 1366 | CTX-160b | CCTGCAGGCAGCTGCGCGCTCGCTCGCTCACTGAGGCCGCCCG
GGCGTCGGGCGACCTTTGGTCGCCCGGCCTCAGTGAGCGAGCG
AGCGCGCAGAGAGGGAGTGGCCAACTCCATCACTAGGGGTTCC
TGCGGCCGCACGCGTGAGATGTAAGGAGCTGCTGTGACTTGCT
CAAGGCCTTATATCGAGTAAACGGTAGTGCTGGGGCTTAGACG
CAGGTGTTCTGATTTATAGTTCAAAACCTCTATCAATGAGAGA
GCAATCTCCTGGTAATGTGATAGATTTCCCAACTTAATGCCAAC
ATACCATAAACCTCCCATTCTGCTAATGCCCAGCCTAAGTTGGG
GAGACCACTCCAGATTCCAAGATGTACAGTTTGCTTTGCTGGG
CCTTTTTCCCATGCCTGCCTTTACTCTGCCAGAGTTATATTGCTG
GGGTTTTGAAGAAGATCCTATTAAATAAAAGAATAAGCAGTAT
TATTAAGTAGCCCTGCATTTCAGGTTTCCTTGAGTGGCAGGCCA
GGCCTGGCCGTGAACGTTCACTGAAATCATGGCCTCTTGGCCA
AGATTGATAGCTTGTGCCTGTCCCTGAGTCCCAGTCCATCACGA
GCAGCTGGTTTCTAAGATGCTATTTCCCGTATAAAGCATGAGA
CCGTGACTTGCCAGCCCCACAGAGCCCCGCCCTTGTCCATCACT
GGCATCTGGACTCCAGCCTGGGTTGGGGCAAAGAGGGAAATG
AGATCATGTCCTAACCCTGATCCTCTTGTCCCACAGATATCCAG
AACCCTGACCCTGCCGTGTACCAGCTGAGAGACTCTAAATCCA
GTGACAAGTCTGTCTGCCTATTCACCGATTTTGATTCTCAAACA
AATGTGTCACAAAGTAAGGATTCTGATGTGTATATCACAGACA
AAACTGTGCTAGACATGAGGTCTATGGACTTCAGGCTCCGGTG
CCCGTCAGTGGGCAGAGCGCACATCGCCCACAGTCCCCGAGAA
GTTGGGGGGAGGGGTCGGCAATTGAACCGGTGCCTAGAGAAG
GTGGCGCGGGGTAAACTGGGAAAGTGATGTCGTGTACTGGCTC
CGCCTTTTTCCCGAGGGTGGGGGAGAACCGTATATAAGTGCAG
TAGTCGCCGTGAACGTTCTTTTTCGCAACGGGTTTGCCGCCAGA
ACACAGGTAAGTGCCGTGTGTGGTTCCCGCGGGCCTGGCCTCT
TTACGGGTTATGGCCCTTGCGTGCCTTGAATTACTTCCACTGGC
TGCAGTACGTGATTCTTGATCCCGAGCTTCGGGTTGGAAGTGG
GTGGGAGAGTTCGAGGCCTTGCGCTTAAGGAGCCCCTTCGCCT
CGTGCTTGAGTTGAGGCCTGGCCTGGGCGCTGGGGCCGCCGCG
TGCGAATCTGGTGGCACCTTCGCGCCTGTCTCGCTGCTTTCGAT
AAGTCTCTAGCCATTTAAAATTTTTGATGACCTGCTGCGACGCT
TTTTTTCTGGCAAGATAGTCTTGTAAATGCGGGCCAAGATCTGC
ACACTGGTATTTCGGTTTTTGGGGCCGGGCGGCGACGGGGC
CCGTGCGTCCCAGCGCACATGTTCGGCGAGGCGGGGCCTGCGA
GCGCGGCCACCGAGAATCGGACGGGGGTAGTCTCAAGCTGGCC
GGCCTGCTCTGGTGCCTGGCCTCGCGCCGCCGTGTATCGCCCCG
CCCTGGGCGGCAAGGCTGGCCCGGTCGGCACCAGTTGCGTGAG
CGGAAAGATGGCCGCTTCCCGGCCCTGCTGCAGGGAGCTCAAA |

TABLE 34-continued rAAV Sequences

| SEQ ID NO: | Description | Sequence |
|---|---|---|
| | | ATGGAGGACGCGGCGCTCGGGAGAGCGGGCGGGTGAGTCACC |
| | | CACACAAAGGAAAAGGGCCTTTCCGTCCTCAGCCGTCGCTTCA |
| | | TGTGACTCCACGGAGTACCGGGCGCCGTCCAGGCACCTCGATT |
| | | AGTTCTCGAGCTTTTGGAGTACGTCGTCTTTAGGTTGGGGGGAG |
| | | GGGTTTTATGCGATGGAGTTTCCCCACACTGAGTGGGTGGAGA |
| | | CTGAAGTTAGGCCAGCTTGGCACTTGATGTAATTCTCCTTGGAA |
| | | TTTGCCCTTTTTGAGTTTGGATCTTGGTTCATTCTCAAGCCTCAG |
| | | ACAGTGGTTCAAAGTTTTTTTCTTCCATTTCAGGTGTCGTGACC |
| | | ACCATGGCGCTTCCGGTGACAGCACTGCTCCTCCCCTTGGCGCT |
| | | GTTGCTCCACGCAGCAAGGCCGGAGGTCCAGCTGGTGGAGAGC |
| | | GGCGGAGGACTGGTCCAGCCTGGCGGCTCCCTGAAACTGAGCT |
| | | GCGCCGCCAGCGGCATCGACTTCAGCAGGTACTGGATGAGCTG |
| | | GGTGAGACAGGCCCCTGGCAAGGGCTGGAATGGATCGGCGA |
| | | GATCAACCCCGACTCCAGCACCATCAACTACGCCGACAGCGTC |
| | | AAGGGCAGGTTCACCATTAGCAGGGACAATGCCAAGAACACC |
| | | CTGTACCTGCAGATGAACCTGAGCAGGGCCGAAGACACCGCCC |
| | | TGTACTACTGTGCCAGCCTGTACTACGACTATGGCGACGCTATG |
| | | GACTACTGGGGCCAGGGCACCCTGGTGACAGTGAGCTCCGGAG |
| | | GAGGCGGCAGCGGCGGAGGCGGCAGCGGCGGAGGCGGCAGCG |
| | | ACATCCAGATGACCCAGAGCCCTAGCAGCCTGAGCGCCTCCGT |
| | | GGGAGATAGGGTGACAATCACCTGTAGGGCCAGCCAGAGCGT |
| | | GGACTCCAACGTGGCCTGGTATCAACAGAAGCCCGAGAAGGCC |
| | | CCCAAGAGCCTGATCTTTTCCGCCTCCCTGAGGTTCAGCGGAGT |
| | | CCCCAGCAGGTTCTCCGGATCCGGCTCCGGAACCGACTTTACC |
| | | CTGACCATCTCCAGCCTGCAGCCCGAGGACTTCGCCACCTACT |
| | | ACTGCCAGCAGTACAACAGCTACCCCCTGACCTTCGGCGCCGG |
| | | CACAAAGCTGGAGATCAAGAGTGCTGCTGCCTTTGTCCCGGTA |
| | | TTTCTCCCAGCCAAACCGACCACGACTCCCGCCCCGCGCCCTCC |
| | | GACACCCGCTCCCACCATCGCCTCTCAACCTCTTAGTCTTCGCC |
| | | CCGAGGCATGCCGACCCGCCGCCGGGGGTGCTGTTCATACGAG |
| | | GGGCTTGGACTTCGCTTGTGATATTTACATTTGGGCTCCGTTGG |
| | | CGGGTACGTGCGGCGTCCTTTTGTTGTCACTCGTTATTACTTTG |
| | | TATTGTAATCACAGGAATCGCAAACGGGGCAGAAAGAAACTCC |
| | | TGTATATATTCAAACAACCATTTATGAGACCAGTACAAACTAC |
| | | TCAAGAGGAAGATGGCTGTAGCTGCCGATTTCCAGAAGAAGAA |
| | | GAAGGAGGATGTGAACTGCGAGTGAAGTTTTCCCGAAGCGCAG |
| | | ACGCTCCGGCATATCAGCAAGGACAGAATCAGCTGTATAACGA |
| | | ACTGAATTTGGGACGCCGCGAGGAGTATGACGTGCTTGATAAA |
| | | CGCCGGGGGAGAGACCCGGAAATGGGGGGTAAACCCCGAAGA |
| | | AAGAATCCCCAAGAAGGACTCTACAATGAACTCCAGAAGGAT |
| | | AAGATGGCGGAGGCCTACTCAGAAATAGGTATGAAGGGCGAA |
| | | CGACGACGGGGAAAAGGTCACGATGGCCTCTACCAAGGGTTG |
| | | AGTACGGCAACCAAAGATACGTACGATGCACTGCATATGCAGG |
| | | CCCTGCCTCCCAGATAATAATAAAATCGCTATCCATCGAAGAT |
| | | GGATGTGTGTTGGTTTTTTGTGTGTGGAGCAACAAATCTGACTT |
| | | TGCATGTGCAAACGCCTTCAACAACAGCATTATTCCAGAAGAC |
| | | ACCTTCTTCCCCAGCCCAGGTAAGGGCAGCTTTGGTGCCTTCGC |
| | | AGGCTGTTTCCTTGCTTCAGGAATGGCCAGGTTCTGCCCAGAGC |
| | | TCTGGTCAATGATGTCTAAAACTCCTCTGATTGGTGGTCTCGGC |
| | | CTTATCCATTGCCACCAAAACCCTCTTTTTACTAAGAAACAGTG |
| | | AGCCTTGTTCTGGCAGTCCAGAGAATGACACGGGAAAAAAGCA |
| | | GATGAAGAGAAGGTGGCAGGAGAGGGCACGTGGCCCAGCCTC |
| | | AGTCTCTCCAACTGAGTTCCTGCCTGCCTGCCTTTGCTCAGACT |
| | | GTTTGCCCCTTACTGCTCTTCTAGGCCTCATTCTAAGCCCCTTCT |
| | | CCAAGTTGCCTCTCCTTATTTCTCCCTGTCTGCCAAAAAATCTTT |
| | | CCCAGCTCACTAAGTCAGTCTCACGCAGTCACTCATTAACCCAC |
| | | CAATCACTGATTGTGCCGGCACATGAATGCACCAGGTGTTGAA |
| | | GTGGAGGAATTAAAAAGTCAGATGAGGGGTGTGCCCAGAGGA |
| | | AGCACCATTCTAGTTGGGGGAGCCCATCTGTCAGCTGGGAAAA |
| | | GTCCAAATAACTTCAGATTGGAATGTGTTTTAACTCAGGGTTGA |
| | | GAAAACAGCTACCTTCAGGACAAAAGTCAGGGAAGGGCTCTCT |
| | | GAAGAAATGCTACTTGAAGATACCAGCCCTACCAAGGGCAGG |
| | | GAGAGGACCCTATAGAGGCCTGGGACAGGAGCTCAATGAGAA |
| | | AGGTAACCACGTGCGGACCGAGGCTGCAGCGTCGTCCTCCCTA |
| | | GGAACCCCTAGTGATGGAGTTGGCCACTCCCTCTGCGCGCTC |
| | | GCTCGCTCACTGAGGCCGGGCGACCAAAGGTCGCCCGACGCCC |
| | | GGGCTTTGCCCGGGCGGCCTCAGTGAGCGAGCGAGCGCGCAGC |
| | | TGCCTGCAGG |
| 1367 | CTX-161 | CCTGCAGGCAGCTGCGCGCTCGCTCGCTCACTGAGGCCGCCCG |
| | | GGCGTCGGGCGACCTTTGGTCGCCCGGCCTCAGTGAGCGAGCG |
| | | AGCGCGCAGAGAGGGAGTGGCCAACTCCATCACTAGGGGTTCC |
| | | TGCGGCCGCACGCGTGAGATGTAAGGAGCTGCTGTGACTTGCT |
| | | CAAGGCCTTATATCGAGTAAACGGTAGTGCTGGGGCTTAGACG |
| | | CAGGTGTTCTGATTTATAGTTCAAAACCTCTATCAATGAGAGA |
| | | GCAATCTCCTGGTAATGTGATAGATTTCCCAACTTAATGCCAAC |

TABLE 34-continued rAAV Sequences

SEQ ID NO:Description Sequence

```
ATACCATAAACCTCCCATTCTGCTAATGCCCAGCCTAAGTTGGG
GAGACCACTCCAGATTCCAAGATGTACAGTTTGCTTTGCTGGG
CCTTTTTCCCATGCCTGCCTTTACTCTGCCAGAGTTATATTGCTG
GGGTTTTGAAGAAGATCCTATTAAATAAAAGAATAAGCAGTAT
TATTAAGTAGCCCTGCATTTCAGGTTTCCTTGAGTGGCAGGCCA
GGCCTGGCCGTGAACGTTCACTGAAATCATGGCCTCTTGGCCA
AGATTGATAGCTTGTGCCTGTCCCTGAGTCCCAGTCCATCACGA
GCAGCTGGTTTCTAAGATGCTATTTCCCGTATAAAGCATGAGA
CCGTGACTTGCCAGCCCCACAGAGCCCCGCCCTTGTCCATCACT
GGCATCTGGACTCCAGCCTGGGTTGGGGCAAAGAGGGAAATG
AGATCATGTCCTAACCCTGATCCTCTTGTCCCACAGATATCCAG
AACCCTGACCCTGCCGTGTACCAGCTGAGAGACTCTAAATCCA
GTGACAAGTCTGTCTGCCTATTCACCGATTTTGATTCTCAAACA
AATGTGTCACAAAGTAAGGATTCTGATGTGTATATCACAGACA
AAACTGTGCTAGACATGAGGTCTATGGACTTCAGGCTCCGGTG
CCCGTCAGTGGGCAGAGCGCACATCGCCCACAGTCCCCGAGAA
GTTGGGGGGAGGGGTCGGCAATTGAACCGGTGCCTAGAGAAG
GTGGCGCGGGGTAAACTGGGAAAGTGATGTCGTGTACTGGCTC
CGCCTTTTTCCCGAGGGTGGGGGAGAACCGTATATAAGTGCAG
TAGTCGCCGTGAACGTTCTTTTTCGCAACGGGTTTGCCGCCAGA
ACACAGGTAAGTGCCGTGTGTGGTTCCCGCGGGCCTGGCCTCT
TTACGGGTTATGGCCCTTGCGTGCCTTGAATTACTTCCACTGGC
TGCAGTACGTGATTCTTGATCCCGAGCTTCGGGTTGGAAGTGG
GTGGGAGAGTTCGAGGCCTTGCGCTTAAGGAGCCCCTTCGCCT
CGTGCTTGAGTTGAGGCCTGGCCTGGGCGCTGGGGCCGCCGCG
TGCGAATCTGGTGGCACCTTCGCGCCTGTCTCGCTGCTTTCGAT
AAGTCTCTAGCCATTTAAAATTTTTGATGACCTGCTGCGACGCT
TTTTTTCTGGCAAGATAGTCTTGTAAATGCGGGCCAAGATCTGC
ACACTGGTATTTCGGTTTTTGGGGCCGCGGGCGGCGACGGGGC
CCGTGCGTCCCAGCGCACATGTTCGGCGAGGCGGGCCTGCGA
GCGCGGCCACCGAGAATCGGACGGGGGTAGTCTCAAGCTGGCC
GGCCTGCTCTGGTGCCTGGCCTCGCGCCGCCGTGTATCGCCCCG
CCCTGGGCGGCAAGGCTGGCCCGGTCGGCACCAGTTGCGTGAG
CGGAAAGATGGCCGCTTCCCGGCCCTGCTGCAGGGAGCTCAAA
ATGGAGGACGCGGCGCTCGGGAGAGCGGGCGGGTGAGTCACC
CACACAAAGGAAAAGGGCCTTTCCGTCCTCAGCCGTCGCTTCA
TGTGACTCCACGGAGTACCGGGCGCCGTCCAGGCACCTCGATT
AGTTCTCGAGCTTTTGGAGTACGTCGTCTTTAGGTTGGGGGGAG
GGGTTTTATGCGATGGAGTTTCCCCACACTGAGTGGGTGGAGA
CTGAAGTTAGGCCAGCTTGGCACTTGATGTAATTCTCCTTGGAA
TTTGCCCTTTTTGAGTTTGGATCTTGGTTCATTCTCAAGCCTCAG
ACAGTGGTTCAAAGTTTTTTTCTTCCATTTCAGGTGTCGTGACC
ACCATGGCGCTTCCGGTGACAGCACTGCTCCTCCCCTTGGCGCT
GTTGCTCCACGCAGCAAGGCCGGAGGTGCAGCTGGTGGAGAGC
GGAGGAGGACTGGTGCAGCCCGGAGGCTCCCTGAAGCTGAGCT
GCGCTGCCTCCGGCATCGACTTCAGCAGGTACTGGATGAGCTG
GGTGAGGCAGGCTCCCGGCAAAGGCCTGGAGTGGATCGGCGA
GATCAACCCCGACAGCAGCACCATCAACTACGCCGACAGCGTG
AAGGGCAGGTTCACCATCAGCAGGGACAACGCCAAGAATACC
CTGTACCTGCAGATGAACCTGAGCAGGGCCGAGGACACAGCCC
TGTACTACTGTGCCAGCCTGTACTACGACTATGGAGACGCTAT
GGACTACTGGGGCCAGGGAACCCTGGTGACCGTGAGCAGCGG
AGGCGGAGGCTCCGGCGGCGGAGGCAGCGGAGGAGGCGGCAG
CGATATCCAGATGACCCAGTCCCCCAGCTCCCTGAGCGCTAGC
CCTGGCGACAGGGTGAGCGTGACATGCAAGGCCAGCCAGAGC
GTGGACAGCAACGTGGCCTGGTACCAGCAGAAACCCAGACAG
GCCCCCAAGGCCCTGATCTTCAGCGCCAGCCTGAGGTTTAGCG
GCGTGCCCGCTAGGTTTACCGGATCCGGCAGCGGCACCGACTT
CACCCTGACCATCTCCAACCTGCAGTCCGAGGACTTCGCCACCT
ACTACTGCCAGCAGTACAACAACTACCCCCTGACATTCGGCGC
CGGAACCAAGCTGGAGATCAAGAGTGCTGCTGCCTTTGTCCCG
GTATTTCTCCCAGCCAAACCGACCACGACTCCCGCCCCGCGCC
CTCCGACACCCGCTCCCACCATCGCCTCTCAACCTCTTAGTCTT
CGCCCCGAGGCATGCCGACCCGCCGCCGGGGGTGCTGTTCATA
CGAGGGGCTTGGACTTCGCTTGTGATATTTACATTTGGGCTCCG
TTGGCGGGTACGTGCGGCGTCCTTTTGTTGTCACTCGTTATTAC
TTTGTATTGTAATCACAGGAATCGCTCAAAGCGGAGTAGGTTG
TTGCATTCCGATTACATGAATATGACTCCTCGCCGGCCTGGGCC
GACAAGAAAACATTACCAACCCTATGCCCCCCCACGAGACTTC
GCTGCGTACAGGTCCCGAGTGAAGTTTTCCCGAAGCGCAGACG
CTCCGGCATATCAGCAAGGACAGAATCAGCTGTATAACGAACT
GAATTTGGGACGCCGCGAGGAGTATGACGTGCTTGATAAACGC
CGGGGGAGAGACCCGGAAATGGGGGTAAACCCCGAAGAAAG
AATCCCCAAGAAGGACTCTACAATGAACTCCAGAAGGATAAG
ATGGCGGAGGCCTACTCAGAAATAGGTATGAAGGGCGAACGA
CGACGGGGAAAAGGTCACGATGGCCTCTACCAAGGGTTGAGTA
```

TABLE 34-continued rAAV Sequences

| SEQ ID NO: | Description | Sequence |
|---|---|---|
| | | CGGCAACCAAAGATACGTACGATGCACTGCATATGCAGGCCCT<br>GCCTCCCAGATAATAATAAAATCGCTATCCATCGAAGATGGAT<br>GTGTGTTGGTTTTTTGTGTGTGGAGCAACAAATCTGACTTTGCA<br>TGTGCAAACGCCTTCAACAACAGCATTATTCCAGAAGACACCT<br>TCTTCCCCAGCCCAGGTAAGGGCAGCTTTGGTGCCTTCGCAGG<br>CTGTTTCCTTGCTTCAGGAATGGCCAGGTTCTGCCCAGAGCTCT<br>GGTCAATGATGTCTAAAACTCCTCTGATTGGTGGTCTCGGCCTT<br>ATCCATTGCCACCAAAACCCTCTTTTTACTAAGAAACAGTGAG<br>CCTTGTTCTGGCAGTCCAGAGAATGACACGGGAAAAAAGCAGA<br>TGAAGAGAAGGTGGCAGGAGAGGGCACGTGGCCCAGCCTCAG<br>TCTCTCCAACTGAGTTCCTGCCTGCCTGCCTTTGCTCAGACTGT<br>TTGCCCCTTACTGCTCTTCTAGGCCTCATTCTAAGCCCCTTCTCC<br>AAGTTGCCTCTCCTTATTTCTCCCTGTCTGCCAAAAAATCTTTCC<br>CAGCTCACTAAGTCAGTCTCACGCAGTCACTCATTAACCCACC<br>AATCACTGATTGTGCCGGCACATGAATGCACCAGGTGTTGAAG<br>TGGAGGAATTAAAAAGTCAGATGAGGGGTGTGCCCAGAGGAA<br>GCACCATTCTAGTTGGGGGAGCCCATCTGTCAGCTGGGAAAAG<br>TCCAAATAACTTCAGATTGGAATGTGTTTTAACTCAGGGTTGAG<br>AAAACAGCTACCTTCAGGACAAAAGTCAGGGAAGGGCTCTCTG<br>AAGAAATGCTACTTGAAGATACCAGCCCTACCAAGGGCAGGG<br>AGAGGACCCTATAGAGGCCTGGGACAGGAGCTCAATGAGAAA<br>GGTAACCACGTGCGGACCGAGGCTGCAGCGTCGTCCTCCCTAG<br>GAACCCCTAGTGATGGAGTTGGCCACTCCCTCTCTGCGCGCTCG<br>CTCGCTCACTGAGGCCGGGCGACCAAAGGTCGCCCGACGCCCG<br>GGCTTTGCCCGGGCGGCCTCAGTGAGCGAGCGAGCGCGCAGCT<br>GCCTGCAGG |
| 1368 | CTX-162 | CCTGCAGGCAGCTGCGCGCTCGCTCGCTCACTGAGGCCGCCCG<br>GGCGTCGGGCGACCTTTGGTCGCCCGGCCTCAGTGAGCGAGCG<br>AGCGCGCAGAGAGGGAGTGGCCAACTCCATCACTAGGGGTTCC<br>TGCGGCCGCACGCGTGAGATGTAAGGAGCTGCTGTGACTTGCT<br>CAAGGCCTTATATCGAGTAAACGGTAGTGCTGGGGCTTAGACG<br>CAGGTGTTCTGATTTATAGTTCAAAACCTCTATCAATGAGAGA<br>GCAATCTCCTGGTAATGTGATAGATTTCCCAACTTAATGCCAAC<br>ATACCATAAACCTCCCATTCTGCTAATGCCCAGCCTAAGTTGGG<br>GAGACCACTCCAGATTCCAAGATGTACAGTTTGCTTTGCTGGG<br>CCTTTTTCCCATGCCTGCCTTTACTCTGCCAGAGTTATATTGCTG<br>GGGTTTTGAAGAAGATCCTATTAAATAAAAGAATAAGCAGTAT<br>TATTAAGTAGCCCTGCATTTCAGGTTTCCTTGAGTGGCAGGCCA<br>GGCCTGGCCGTGAACGTTCACTGAAATCATGGCCTCTTGGCCA<br>AGATTGATAGCTTGTGCCTGTCCCTGAGTCCCAGTCCATCACGA<br>GCAGCTGGTTTCTAAGATGCTATTTCCCGTATAAAGCATGAGA<br>CCGTGACTTGCCAGCCCCACAGAGCCCCGCCCTTGTCCATCACT<br>GGCATCTGGACTCCAGCCTGGGTTGGGGCAAAGAGGGAAATG<br>AGATCATGTCCTAACCCTGATCCTCTTGTCCCACAGATATCCAG<br>AACCCTGACCCTGCCGTGTACCAGCTGAGAGACTCTAAATCCA<br>GTGACAAGTCTGTCTGCCTATTCACCGATTTTGATTCTCAAACA<br>AATGTGTCACAAAGTAAGGATTCTGATGTGTATATCACAGACA<br>AAACTGTGCTAGACATGAGGTCTATGGACTTCAGGCTCCGGTG<br>CCCGTCAGTGGGCAGAGCGCACATCGCCCACAGTCCCCGAGAA<br>GTTGGGGGGAGGGGTCGGCAATTGAACCGGTGCCTAGAGAAG<br>GTGGCGCGGGGTAAACTGGGAAAGTGATGTCGTGTACTGGCTC<br>CGCCTTTTTCCCGAGGGTGGGGGAGAACCGTATATAAGTGCAG<br>TAGTCGCCGTGAACGTTCTTTTTCGCAACGGGTTTGCCGCCAGA<br>ACACAGGTAAGTGCCGTGTGTGGTTCCCGCGGGCCTGGCCTCT<br>TTACGGGTTATGGCCCTTGCGTGCCTTGAATTACTTCCACTGGC<br>TGCAGTACGTGATTCTTGATCCCGAGCTTCGGGTTGGAAGTGG<br>GTGGGAGAGTTCGAGGCCTTGCGCTTAAGGAGCCCCTTCGCCT<br>CGTCGTTGAGTTGAGGCCTGGCCTGGGCGCTGGGGCCGCCGCG<br>TGCGAATCTGGTGGCACCTTCGCGCCTGTCTCGCTGCTTTCGAT<br>AAGTCTCTAGCCATTTAAAATTTTTGATGACCTGCTGCGACGCT<br>TTTTTTCTGGCAAGATAGTCTTGTAAATGCGGGCCAAGATCTGC<br>ACACTGGTATTTCGGTTTTTGGGGCCGCGGGCGGCGACGGGGC<br>CCGTGCGTCCCAGCGCACATGTTCGGCGAGGCGGGGCCTGCGA<br>GCGCGGCCACCGAGAATCGGACGGGGGTAGTCTCAAGCTGGCC<br>GGCCTGCTCTGGTGCCTGGCCTCGCGCCGCCGTGTATCGCCCCG<br>CCCTGGGCGGCAAGGCTGGCCCGGTCGGCACCAGTTGCGTGAG<br>CGGAAAGATGGCCGCTTCCCGGCCCTGCTGCAGGGAGCTCAAA<br>ATGGAGGACGCGGCGCTCGGGAGAGCGGGCGGGTGAGTCACC<br>CACACAAAGGAAAAGGGCCTTTCCGTCCTCAGCCGTCGCTTCA<br>TGTGACTCCACGGAGTACCGGGCGCCGTCCAGGCACCTCGATT<br>AGTTCTCGAGCTTTTGGAGTACGTCGTCTTTAGGTTGGGGGGAG<br>GGGTTTTATGCGATGGAGTTTCCCCACACTGAGTGGGTGGAGA<br>CTGAAGTTAGGCCAGCTTGGCACTTGATGTAATTCTCCTTGGAA<br>TTTGCCCTTTTTGAGTTTGGATCTTGGTTCATTCTCAAGCCTCAG<br>ACAGTGGTTCAAAGTTTTTTTCTTCCATTTCAGGTGTCGTGACC |

TABLE 34-continued rAAV Sequences

| SEQ ID NO: | Description | Sequence |
|---|---|---|
| | | ACCATGGCGCTTCCGGTGACAGCACTGCTCCTCCCCTTGGCGCT GTTGCTCCACGCAGCAAGGCCGGACATCCAGATGACCCAGAGC CCTAGCAGCCTGAGCGCTAGCGTGGGCGACAGGGTGACCATCA CCTGCAGGGCCAGCCAGAGCGTGGACTCCAACGTGGCCTGGTA CCAGCAGAAGCCCGAGAAGGCCCCCAAGAGCCTGATCTTCAGC GCCAGCCTGAGGTTCTCCGGAGTGCCTAGCAGATTTAGCGGCA GCGGCAGCGGCACAGACTTCACCCTGACCATCAGCAGCCTCCA GCCCGAGGATTTCGCCACCTACTACTGCCAGCAGTACAACTCC TACCCCCTGACCTTCGGCGCCGGCACAAAGCTGGAGATCAAGG GAGGAGGAGGAAGCGGAGGAGGAGGAAGCGGAGGCGGAGGA AGCGAGGTGCAGCTGGTGGAGTCCGGAGGAGGCCTGGTGCAA CCTGGAGGCAGCCTGAAGCTGAGCTGTGCCGCCAGCGGAATCG ACTTCAGCAGGTACTGGATGTCCTGGGTGAGACAGGCCCCTGG CAAGGGCCTGGAGTGGATCGGAGAGATCAACCCCGACAGCTCC ACCATCAACTACGCCGACAGCGTGAAGGGCAGGTTCACCATCA GCAGAGACAACGCCAAGAACACCCTGTACCTGCAGATGAACCT GTCCAGAGCCGAGGACACCGCCCTGTACTACTGCGCCAGCCTG TATTACGACTACGGCGACGCTATGGACTACTGGGGCCAGGGCA CCCTGGTGACAGTGAGCAGCAGTGCTGCTGCCTTTGTCCCGGT ATTTCTCCCAGCCAAACCGACCACGACTCCCGCCCCGCGCCCTC CGACACCCGCTCCCACCATCGCCTCTCAACCTCTTAGTCTTCGC CCCGAGGCATGCCGACCCGCCGCCGGGGGTGCTGTTCATACGA GGGGCTTGGACTTCGCTTGTGATATTTACATTTGGGCTCCGTTG GCGGGTACGTGCGGCGTCCTTTTGTTGTCACTCGTTATTACTTT GTATTGTAATCACAGGAATCGCTCAAAGCGGAGTAGGTTGTTG CATTCCGATTACATGAATATGACTCCTCGCCGGCCTGGGCCGA CAAGAAAACATTACCAACCCTATGCCCCCCACGAGACTTCGC TGCGTACAGGTCCCGAGTGAAGTTTTCCCGAAGCGCAGACGCT CCGGCATATCAGCAAGGACAGAATCAGCTGTATAACGAACTGA ATTTGGGACGCCGCGAGGAGTATGACGTGCTTGATAAACGCCG GGGGAGAGACCCGGAAATGGGGGGTAAACCCCGAAGAAAGAA TCCCCAAGAAGGACTCTACAATGAACTCCAGAAGGATAAGATG GCGGAGGCCTACTCAGAAATAGGTATGAAGGGCGAACGACGA CGGGGAAAAGGTCACGATGGCCTCTACCAAGGGTTGAGTACGG CAACCAAAGATACGTACGATGCACTGCATATGCAGGCCCTGCC TCCCAGATAATAATAAAATCGCTATCCATCGAAGATGGATGTG TGTTGGTTTTTTGTGTGTGGAGCAACAAATCTGACTTTGCATGT GCAAACGCCTTCAACAACAGCATTATTCCAGAAGCACCTTCT TCCCCAGCCCAGGTAAGGGCAGCTTTGGTGCCTTCGCAGGCTG TTTCCTTGCTTCAGGAATGGCCAGGTTCTGCCCAGAGCTCTGGT CAATGATGTCTAAAACTCCTCTGATTGGTGGTCTCGGCCTTATC CATTGCCACCAAAACCCTCTTTTTACTAAGAAACAGTGAGCCTT GTTCTGGCAGTCCAGAGAATGACACGGGAAAAAAGCAGATGA AGAGAAGGTGGCAGGAGAGGGCACGTGGCCCAGCCTCAGTCT CTCCAACTGAGTTCCTGCCTGCCTGCCTTTGCTCAGACTGTTTG CCCCTTACTGCTCTTCTAGGCCTCATTCTAAGCCCCTTCTCCAA GTTGCCTCTCCTTATTTCTCCCTGTCTGCCAAAAAATCTTTCCCA GCTCACTAAGTCAGTCTCACGCAGTCACTCATTAACCCACCAAT CACTGATTGTGCCGGCACATGAATGCACCAGGTGTTGAAGTGG AGGAATTAAAAAGTCAGATGAGGGGTGTGCCCAGAGGAAGCA CCATTCTAGTTGGGGGAGCCCATCTGTCAGCTGGGAAAAGTCC AAATAACTTCAGATTGGAATGTGTTTTAACTCAGGGTTGAGAA AACAGCTACCTTCAGGACAAAAGTCAGGGAAGGGCTCTCTGAA GAAATGCTACTTGAAGATACCAGCCCTACCAAGGGCAGGGAG AGGACCCTATAGAGGCCTGGGACAGGAGCTCAATGAGAAAGG TAACCACGTGCGGACCGAGGCTGCAGCGTCGTCCTCCCTAGGA ACCCCTAGTGATGGAGTTGGCCACTCCCTCTCTGCGCGCTCGCT CGCTCACTGAGGCCGGGCGACCAAAGGTCGCCCGACGCCCGGG CTTTGCCCGGCGGCCTCAGTGAGCGAGCGAGCGCGCAGCTGC CTGCAGG |
| 1369 | CTX-163 | CCTGCAGGCAGCTGCGCGCTCGCTCGCTCACTGAGGCCGCCCG GGCGTCGGGCGACCTTTGGTCGCCCGGCCTCAGTGAGCGAGCG AGCGCGCAGAGAGGGAGTGGCCAACTCCATCACTAGGGGTTCC TGCGGCCGCACGCGTGAGATGTAAGGAGCTGCTGTGACTTGCT CAAGGCCTTATATCGAGTAAACGGTAGTGCTGGGGCTTAGACG CAGGTGTTCTGATTTATAGTTCAAAACCTCTATCAATGAGAGA GCAATCTCCTGGTAATGTGATAGATTTCCCAACTTAATGCCAAC ATACCATAAACCTCCCATTCTGCTAATGCCCAGCCTAAGTTGGG GAGACCACTCCAGATTCCAAGATGTACAGTTTGCTTTGCTGGG CCTTTTTCCCATGCCTGCCTTTACTCTGCCAGAGTTATATTGCTG GGGTTTTGAAGAAGATCCTATTAAATAAAAGAATAAGCAGTAT TATTAAGTAGCCCTGCATTTCAGGTTTCCTTGAGTGGCAGGCCA GGCCTGGCCGTGAACGTTCACTGAAATCATGGCCTCTTGGCCA AGATTGATAGCTTGTGCCTGTCCCTGAGTCCCAGTCCATCACGA GCAGCTGGTTTCTAAGATGCTATTTCCCGTATAAAGCATGAGA |

TABLE 34-continued rAAV Sequences

SEQ ID NO:Description Sequence

CCGTGACTTGCCAGCCCCACAGAGCCCCGCCCTTGTCCATCACT
GGCATCTGGACTCCAGCCTGGGTTGGGGCAAAGAGGGAAATG
AGATCATGTCCTAACCCTGATCCTCTTGTCCCACAGATATCCAG
AACCCTGACCCTGCCGTGTACCAGCTGAGAGACTCTAAATCCA
GTGACAAGTCTGTCTGCCTATTCACCGATTTTGATTCTCAAACA
AATGTGTCACAAAGTAAGGATTCTGATGTGTATATCACAGACA
AAACTGTGCTAGACATGAGGTCTATGGACTTCAGGCTCCGGTG
CCCGTCAGTGGGCAGAGCGCACATCGCCCACAGTCCCCGAGAA
GTTGGGGGGAGGGGTCGGCAATTGAACCGGTGCCTAGAGAAG
GTGGCGCGGGGTAAACTGGGAAAGTGATGTCGTGTACTGGCTC
CGCCTTTTTCCCGAGGGTGGGGGAGAACCGTATATAAGTGCAG
TAGTCGCCGTGAACGTTCTTTTTCGCAACGGGTTTGCCGCCAGA
ACACAGGTAAGTGCCGTGTGTGGTTCCCGCGGGCCTGGCCTCT
TTACGGGTTATGGCCCTTGCGTGCCTTGAATTACTTCCACTGGC
TGCAGTACGTGATTCTTGATCCCGAGCTTCGGGTTGGAAGTGG
GTGGGAGAGTTCGAGGCCTTGCGCTTAAGGAGCCCCTTCGCCT
CGTGCTTGAGTTGAGGCCTGGCCTGGGCGCTGGGGCCGCCGCG
TGCGAATCTGGTGGCACCTTCGCGCCTGTCTCGCTGCTTTCGAT
AAGTCTCTAGCCATTTAAAATTTTTGATGACCTGCTGCGACGCT
TTTTTTCTGGCAAGATAGTCTTGTAAATGCGGGCCAAGATCTGC
ACACTGGTATTTCGGTTTTTGGGGCCGCGGGCGGCGACGGGGC
CCGTGCGTCCCAGCGCACATGTTCGGCGAGGCGGGGCCTGCGA
GCGCGGCCACCGAGAATCGGACGGGGGTAGTCTCAAGCTGGCC
GGCCTGCTCTGGTGCCTGGCCTCGCGCCGCCGTGTATCGCCCCG
CCCTGGGCGGCAAGGCTGGCCCGGTCGGCACCAGTTGCGTGAG
CGGAAAGATGGCCGCTTCCCGGCCCTGCTGCAGGGAGCTCAAA
ATGGAGGACGCGGCGCTCGGGAGAGCGGGCGGGTGAGTCACC
CACACAAAGGAAAAGGGCCTTTCCGTCCTCAGCCGTCGCTTCA
TGTGACTCCACGGAGTACCGGGCGCCGTCCAGGCACCTCGATT
AGTTCTCGAGCTTTTGGAGTACGTCGTCTTTAGGTTGGGGGGAG
GGGTTTTATGCGATGGAGTTTCCCCACACTGAGTGGGTGGAGA
CTGAAGTTAGGCCAGCTTGGCACTTGATGTAATTCTCCTTGGAA
TTTGCCCTTTTTGAGTTTGGATCTTGGTTCATTCTCAAGCCTCAG
ACAGTGGTTCAAAGTTTTTTTCTTCCATTTCAGGTGTCGTGACC
ACCATGGCGCTTCCGGTGACAGCACTGCTCCTCCCCTTGGCGCT
GTTGCTCCACGCAGCAAGGCCGGACATCCAAATGACCCAGTCC
CCTAGCAGCCTGTCCGCCAGCCCTGGAGACAGGGTGTCCGTGA
CCTGCAAGGCCAGCCAGTCCGTGGACAGCAACGTCGCCTGGTA
TCAGCAGAAGCCCAGGCAAGCTCCCAAGGCTCTGATCTTCTCC
GCCAGCCTGAGATTTTCCGGCGTGCCCGCCAGATTCACCGGAA
GCGGCAGCGGCACCGACTTCACCCTGACCATCAGCAACCTGCA
GAGCGAGGATTTCGCCACATACTACTGCCAGCAGTACAACAAC
TACCCCCTGACCTTCGGAGCCGGCACCAAGCTGGAGATCAAAG
GCGGCGGAGGCAGCGGCGGCGGCGGCAGCGGCGGAGGCGGAT
CCGAAGTGCAGCTGGTGGAAAGCGGAGGCGGACTCGTGCAGC
CTGGCGGAAGCCTGAAGCTGAGCTGTGCCGCCAGCGGCATCGA
CTTCAGCAGGTACTGGATGAGCTGGGTGAGGCAGGCTCCCGGC
AAAGGCCTGGAGTGGATCGGCGAGATCAACCCTGACAGCAGC
ACCATCAACTACGCCGACAGCGTGAAAGGCAGGTTCACCATCA
GCAGGGACAACGCCAAGAACACCCTGTACCTGCAGATGAACCT
GTCCAGAGCCGAGGACACCGCCCTGTACTACTGCGCCAGCCTG
TACTACGACTACGGCGACGCTATGGACTACTGGGGCCAAGGCA
CCCTCGTGACCGTCAGCTCCAGTGCTGCTGCCTTTGTCCCGGTA
TTTCTCCCAGCCAAACCGACCACGACTCCCGCCCCGCGCCCTCC
GACACCCGCTCCCACCATCGCCTCTCAACCTCTTAGTCTTCGCC
CCGAGGCATGCCGACCCGCCGCCGGGGGTGCTGTTCATACGAG
GGGCTTGGACTTCGCTTGTGATATTTACATTTGGGCTCCGTTGG
CGGGTACGTGCGCGTCCTTTTGTTGTCACTCGTTATTACTTTG
TATTGTAATCACAGGAATCGCTCAAAGCGGAGTAGGTTGTTGC
ATTCCGATTACATGAATATGACTCCTCGCCGGCCTGGGCCGAC
AAGAAAACATTACCAACCCTATGCCCCCCACGAGACTTCGCT
GCGTACAGGTCCCGAGTGAAGTTTTCCCGAAGCGCAGACGCTC
CGGCATATCAGCAAGGACAGAATCAGCTGTATAACGAACTGAA
TTTGGGACGCCGCGAGGAGTATGACGTGCTTGATAAACGCCGG
GGGAGAGACCCGGAAATGGGGGGTAAACCCGAAGAAAGAAT
CCCCAAGAAGGACTCTACAATGAACTCCAGAAGGATAAGATG
GCGGAGGCCTACTCAGAAATAGGTATGAAGGGCGAACGACGA
CGGGGAAAAGGTCACGATGGCCTCTACCAAGGGTTGAGTACGG
CAACCAAAGATACGTACGATGCACTGCATATGCAGGCCCTGCC
TCCCAGATAATAATAAAATCGCTATCCATCGAAGATGGATGTG
TGTTGGTTTTTTGTGTGTGGAGCAACAAATCTGACTTTGCATGT
GCAAACGCCTTCAACAACAGCATTATTCCAGAAGACACCTTCT
TCCCCAGCCCAGGTAAGGGCAGCTTTGGTGCCTTCGCAGGCTG
TTTCCTTGCTTCAGGAATGGCCAGGTTCTGCCCAGAGCTCTGGT
CAATGATGTCTAAAACTCCTCTGATTGGTGGTCTCGGCCTTATC
CATTGCCACCAAAACCCTCTTTTTACTAAGAAACAGTGAGCCTT

TABLE 34-continued rAAV Sequences

| SEQ ID NO: | Description | Sequence |
|---|---|---|
| | | GTTCTGGCAGTCCAGAGAATGACACGGGAAAAAAGCAGATGA<br>AGAGAAGGTGGCAGGAGAGGGCACGTGGCCCAGCCTCAGTCT<br>CTCCAACTGAGTTCCTGCCTGCCTGCCTTTGCTCAGACTGTTTG<br>CCCCTTACTGCTCTTCTAGGCCTCATTCTAAGCCCCTTCTCCAA<br>GTTGCCTCTCCTTATTTCTCCCTGTCTGCCAAAAAATCTTTCCCA<br>GCTCACTAAGTCAGTCTCACGCAGTCACTCATTAACCCACCAAT<br>CACTGATTGTGCCGGCACATGAATGCACCAGGTGTTGAAGTGG<br>AGGAATTAAAAAGTCAGATGAGGGGTGTGCCCAGAGGAAGCA<br>CCATTCTAGTTGGGGGAGCCCATCTGTCAGCTGGGAAAAGTCC<br>AAATAACTTCAGATTGGAATGTGTTTTAACTCAGGGTTGAGAA<br>AACAGCTACCTTCAGGACAAAAGTCAGGGAAGGGCTCTCTGAA<br>GAAATGCTACTTGAAGATACCAGCCCTACCAAGGGCAGGGAG<br>AGGACCCTATAGAGGCCTGGGACAGGAGCTCAATGAGAAAGG<br>TAACCACGTGCGGACCGAGGCTGCAGCGTCGTCCTCCCTAGGA<br>ACCCCTAGTGATGGAGTTGGCCACTCCCTCTCTGCGCGCTCGCT<br>CGCTCACTGAGGCCGGGCGACCAAAGGTCGCCCGACGCCCGGG<br>CTTTGCCCGGGCGGCCTCAGTGAGCGAGCGAGCGCGCAGCTGC<br>CTGCAGG |
| 1370 | CTX-164 | CCTGCAGGCAGCTGCGCGCTCGCTCGCTCACTGAGGCCGCCCG<br>GGCGTCGGGCGACCTTTGGTCGCCCGGCCTCAGTGAGCGAGCG<br>AGCGCGCAGAGAGGGAGTGGCCAACTCCATCACTAGGGGTTCC<br>TGCGGCCGCACGCGTGAGATGTAAGGAGCTGCTGTGACTTGCT<br>CAAGGCCTTATATCGAGTAAACGGTAGTGCTGGGGCTTAGACG<br>CAGGTGTTCTGATTTATAGTTCAAAACCTCTATCAATGAGAGA<br>GCAATCTCCTGGTAATGTGATAGATTTCCCAACTTAATGCCAAC<br>ATACCATAAACCTCCCATTCTGCTAATGCCCAGCCTAAGTTGGG<br>GAGACCACTCCAGATTCCAAGATGTACAGTTTGCTTTGCTGGG<br>CCTTTTTCCCATGCCTGCCTTTACTCTGCCAGAGTTATATTGCTG<br>GGGTTTTGAAGAAGATCCTATTAAATAAAAGAATAAGCAGTAT<br>TATTAAGTAGCCCTGCATTTCAGGTTTCCTTGAGTGGCAGGCCA<br>GGCCTGGCCGTGAACGTTCACTGAAATCATGGCCTCTTGGCCA<br>AGATTGATAGCTTGTGCCTGTCCCTGAGTCCCAGTCCATCACGA<br>GCAGCTGGTTTCTAAGATGCTATTTCCCGTATAAAGCATGAGA<br>CCGTGACTTGCCAGCCCCACAGAGCCCCGCCCTTGTCCATCACT<br>GGCATCTGGACTCCAGCCTGGGTTGGGGCAAAGAGGGAAATG<br>AGATCATGTCCTAACCCTGATCCTCTTGTCCCACAGATATCCAG<br>AACCCTGACCCTGCCGTGTACCAGCTGAGAGACTCTAAATCCA<br>GTGACAAGTCTGTCTGCCTATTCACCGATTTTGATTCTCAAACA<br>AATGTGTCACAAAGTAAGGATTCTGATGTGTATATCACAGACA<br>AAACTGTGCTAGACATGAGGTCTATGGACTTCAGGCTCCGGTG<br>CCCGTCAGTGGGCAGAGCGCACATCGCCCACAGTCCCCGAGAA<br>GTTGGGGGGAGGGGTCGGCAATTGAACCGGTGCCTAGAGAAG<br>GTGGCGCGGGGTAAACTGGGAAAGTGATGTCGTGTACTGGCTC<br>CGCCTTTTTCCCGAGGGTGGGGGAGAACCGTATATAAGTGCAG<br>TAGTCGCCGTGAACGTTCTTTTTCGCAACGGGTTTGCCGCCAGA<br>ACACAGGTAAGTGCCGTGTGTGGTTCCCGCGGGCCTGGCCTCT<br>TTACGGGTTATGGCCCTTGCGTGCCTTGAATTACTTCCACTGGC<br>TGCAGTACGTGATTCTTGATCCCGAGCTTCGGGTTGGAAGTGG<br>GTGGGAGAGTTCGAGGCCTTGCGCTTAAGGAGCCCCTTCGCCT<br>CGTGCTTGAGTTGAGGCCTGGCCTGGGCGCTGGGGCCGCCGCG<br>TGCGAATCTGGTGGCACCTTCGCGCCTGTCTCGCTGCTTTCGAT<br>AAGTCTCTAGCCATTTAAAATTTTTGATGACCTGCTGCGACGCT<br>TTTTTTCTGGCAAGATAGTCTTGTAAATGCGGGCCAAGATCTGC<br>ACACTGGTATTTCGGTTTTTGGGGCCGCGGGCGGCGACGGGGC<br>CCGTGCGTCCCAGCGCACATGTTCGGCGAGGCGGGGCCTGCGA<br>GCGCGGCCACCGAGAATCGGACGGGGGTAGTCTCAAGCTGGCC<br>GGCCTGCTCTGGTGCCTGGCCTCGCGCCGCCGTGTATCGCCCCG<br>CCCTGGGCGGCAAGGCTGGCCCGGTCGGCACCAGTTGCGTGAG<br>CGGAAAGATGGCCGCTTCCCGGCCCTGCTGCAGGGAGCTCAAA<br>ATGGAGGACGCGGCGCTCGGGAGAGCGGGCGGGTGAGTCACC<br>CACACAAAGGAAAAGGGCCTTTCCGTCCTCAGCCGTCGCTTCA<br>TGTGACTCCACGGAGTACCGGGCGCCGTCCAGGCACCTCGATT<br>AGTTCTCGAGCTTTTGGAGTACGTCGTCTTTAGGTTGGGGGGAG<br>GGGTTTTATGCGATGGAGTTTCCCCACACTGAGTGGGTGGAGA<br>CTGAAGTTAGGCCAGCTTGGCACTTGATGTAATTCTCCTTGGAA<br>TTTGCCCTTTTTGAGTTTGGATCTTGGTTCATTCTCAAGCCTCAG<br>ACAGTGGTTCAAAGTTTTTTCTTCCATTTCAGGTGTCGTGACC<br>ACCATGGCGCTTCCGGTGACAGCACTGCTCCTCCCCTTGGCGCT<br>GTTGCTCCACGCAGCAAGGCCGGAGGTGCAGCTGCAGCAGTCC<br>GGCCCTGAGCTCGTGAAGCCTGGAGCCAGCGTGAAAATGAGCT<br>GTAAGGCCTCCGGCAACACCCTCACCAACTACGTGATCCATTG<br>GATGAAGCAGATGCCCGGCCAGGGCCTGGACTGGATTGGCTAC<br>ATTCTGCCCTACAACGACCTGACCAAGTACAACGAGAAGTTCA<br>CCGGCAAGGCCACCCTGACCAGCGATAAGAGCTCCAGCAGCGC<br>CTACATGGAGCTGAACTCCCTGACCAGCGAGGACAGCGCCGTG |

TABLE 34-continued rAAV Sequences

| SEQ ID NO: | Description | Sequence |
|---|---|---|
| | | TACTACTGCACCAGGTGGGACTGGGATGGCTTCTTCGACCCCT
GGGGACAGGGCACCACCCTGACAGTGTCCAGCGGAGGAGGCG
GCAGCGGCGGCGGCGGCTCCGGCGGCGGCGGCAGCGATATCG
TGATGACACAGTCCCCTCTGAGCCTGCCTGTGAGCCTGGGCGA
CCAGGCCAGCATCAGCTGCAGGTCCACCCAGTCCCTGGTGCAC
TCCAACGGCAACACCCACCTGCACTGGTACCTGCAAAGGCCCG
GCCAGTCCCCTAAGCTGCTGATCTACAGCGTGAGCAACAGGTT
TAGCGAGGTGCCCGATAGATTTTCCGCCAGCGGCAGCGGCACC
GACTTCACACTGAAGATCTCCAGGGTGGAGGCCGAGGATCTGG
GCGTGTACTTCTGCAGCCAGACCAGCCACATCCCCTACACCTTC
GGCGGCGGAACCAAGCTGGAGATCAAGAGTGCTGCTGCCTTTG
TCCCGGTATTTCTCCCAGCCAAACCGACCACGACTCCCGCCCCG
CGCCCTCCGACACCCGCTCCCACCATCGCCTCTCAACCTCTTAG
TCTTCGCCCCGAGGCATGCCGACCCGCCGCCGGGGGTGCTGTT
CATACGAGGGGCTTGGACTTCGCTTGTGATATTTACATTTGGGC
TCCGTTGGCGGGTACGTGCGGCGTCCTTTTGTTGTCACTCGTTA
TTACTTTGTATTGTAATCACAGGAATCGCTCAAAGCGGAGTAG
GTTGTTGCATTCCGATTACATGAATATGACTCCTCGCCGGCCTG
GGCCGACAAGAAAACATTACCAACCCTATGCCCCCCCACGAGA
CTTCGCTGCGTACAGGTCCCGAGTGAAGTTTTCCCGAAGCGCA
GACGCTCCGGCATATCAGCAAGGACAGAATCAGCTGTATAACG
AACTGAATTTGGGACGCCGCGAGGAGTATGACGTGCTTGATAA
ACGCCGGGGAGAGACCCGGAAATGGGGGGTAAACCCCGAAG
AAAGAATCCCCAAGAAGGACTCTACAATGAACTCCAGAAGGA
TAAGATGGCGGAGGCCTACTCAGAAATAGGTATGAAGGGCGA
ACGACGACGGGGAAAAGGTCACGATGGCCTCTACCAAGGGTT
GAGTACGGCAACCAAAGATACGTACGATGCACTGCATATGCAG
GCCCTGCCTCCCAGATAATAATAAAATCGCTATCCATCGAAGA
TGGATGTGTGTTGGTTTTTTGTGTGTGGAGCAACAAATCTGACT
TTGCATGTGCAAACGCCTTCAACAACAGCATTATTCCAGAAGA
CACCTTCTTCCCCAGCCCAGGTAAGGGCAGCTTTGGTGCCTTCG
CAGGCTGTTTCCTTGCTTCAGGAATGGCCAGGTTCTGCCCAGAG
CTCTGGTCAATGATGTCTAAAACTCCTCTGATTGGTGGTCTCGG
CCTTATCCATTGCCACCAAAACCCTCTTTTTACTAAGAAACAGT
GAGCCTTGTTCTGGCAGTCCAGAGAATGACACGGGAAAAAAGC
AGATGAAGAGAAGGTGGCAGGAGAGGGCACGTGGCCCAGCCT
CAGTCTCTCCAACTGAGTTCCTGCCTGCCTGCCTTTGCTCAGAC
TGTTTGCCCCTTACTGCTCTTCTAGGCCTCATTCTAAGCCCCTTC
TCCAAGTTGCCTCTCCTTATTTCTCCCTGTCTGCCAAAAATCTT
TCCCAGCTCACTAAGTCAGTCTCACGCAGTCACTCATTAACCCA
CCAATCACTGATTGTGCCGGCACATGAATGCACCAGGTGTTGA
AGTGGAGGAATTAAAAAGTCAGATGAGGGGTGTGCCCAGAGG
AAGCACCATTCTAGTTGGGGGAGCCCATCTGTCAGCTGGGAAA
AGTCCAAATAACTTCAGATTGGAATGTGTTTTAACTCAGGGTTG
AGAAAACAGCTACCTTCAGGACAAAAGTCAGGGAAGGGCTCT
CTGAAGAAATGCTACTTGAAGATACCAGCCCTACCAAGGGCAG
GGAGAGGACCCTATAGAGGCCTGGGACAGGAGCTCAATGAGA
AAGGTAACCACGTGCGGACCGAGGCTGCAGCGTCGTCCTCCCT
AGGAACCCCTAGTGATGGAGTTGGCCACTCCCTCTCTGCGCGC
TCGCTCGCTCACTGAGGCCGGGCGACCAAAGGTCGCCCGACGC
CCGGGCTTTGCCCGGGCGGCCTCAGTGAGCGAGCGAGCGCGCA
GCTGCCTGCAGG |
| 1371 | CTX-165 | CCTGCAGGCAGCTGCGCGCTCGCTCGCTCACTGAGGCCGCCCG
GGCGTCGGGCGACCTTTGGTCGCCCGGCCTCAGTGAGCGAGCG
AGCGCGCAGAGAGGGAGTGGCCAACTCCATCACTAGGGGTTCC
TGCGGCCGCACGCGTGAGATGTAAGGAGCTGCTGTGACTTGCT
CAAGGCCTTATATCGAGTAAACGGTAGTGCTGGGGCTTAGACG
CAGGTGTTCTGATTTATAGTTCAAAACCTCTATCAATGAGAGA
GCAATCTCCTGGTAATGTGATAGATTTCCCAACTTAATGCCAAC
ATACCATAAACCTCCCATTCTGCTAATGCCCAGCCTAAGTTGGG
GAGACCACTCCAGATTCCAAGATGTACAGTTTGCTTTGCTGGG
CCTTTTTCCCATGCCTGCCTTTACTCTGCCAGAGTTATATTGCTG
GGGTTTTGAAGAAGATCCTATTAAATAAAAGAATAAGCAGTAT
TATTAAGTAGCCCTGCATTTCAGGTTTCCTTGAGTGGCAGGCCA
GGCCTGGCCGTGAACGTTCACTGAAATCATGGCCTCTTGGCCA
AGATTGATAGCTTGTGCCTGTCCCTGAGTCCCAGTCCATCACGA
GCAGCTGGTTTCTAAGATGCTATTTCCCGTATAAAGCATGAGA
CCGTGACTTGCCAGCCCCACAGAGCCCCGCCCTTGTCCATCACT
GGCATCTGGACTCCAGCCTGGGTTGGGGCAAAGAGGGAAATG
AGATCATGTCCTAACCCTGATCCTCTTGTCCCACAGATATCCAG
AACCCTGACCCTGCCGTGTACCAGCTGAGAGACTCTAAATCCA
GTGACAAGTCTGTCTGCCTATTCACCGATTTTGATTCTCAAACA
AATGTGTCACAAAGTAAGGATTCTGATGTGTATATCACAGACA
AAACTGTGCTAGACATGAGGTCTATGGACTTCAGGCTCCGGTG
CCCGTCAGTGGGCAGAGCGCACATCGCCCACAGTCCCCGAGAA |

TABLE 34-continued rAAV Sequences

SEQ ID NO:Description Sequence

```
GTTGGGGGGAGGGGTCGGCAATTGAACCGGTGCCTAGAGAAG
GTGGCGCGGGGTAAACTGGGAAAGTGATGTCGTGTACTGGCTC
CGCCTTTTTCCCGAGGGTGGGGGAGAACCGTATATAAGTGCAG
TAGTCGCCGTGAACGTTCTTTTTCGCAACGGGTTTGCCGCCAGA
ACACAGGTAAGTGCCGTGTGTGGTTCCCGCGGGCCTGGCCTCT
TTACGGGTTATGGCCCTTGCGTGCCTTGAATTACTTCCACTGGC
TGCAGTACGTGATTCTTGATCCCGAGCTTCGGGTTGGAAGTGG
GTGGGAGAGTTCGAGGCCTTGCGCTTAAGGAGCCCCTTCGCCT
CGTGCTTGAGTTGAGGCCTGGCCTGGGCGCTGGGGCCGCCGCG
TGCGAATCTGGTGGCACCTTCGCGCCTGTCTCGCTGCTTTCGAT
AAGTCTCTAGCCATTTAAAATTTTTGATGACCTGCTGCGACGCT
TTTTTTCTGGCAAGATAGTCTTGTAAATGCGGGCCAAGATCTGC
ACACTGGTATTTCGGTTTTTGGGGCCGCGGGCGGCGACGGGGC
CCGTGCGTCCCAGCGCACATGTTCGGCGAGGCGGGGCCTGCGA
GCGCGGCCACCGAGAATCGGACGGGGGTAGTCTCAAGCTGGCC
GGCCTGCTCTGGTGCCTGGCCTCGCGCCGCCGTGTATCGCCCCG
CCCTGGGCGGCAAGGCTGGCCCGGTCGGCACCAGTTGCGTGAG
CGGAAAGATGGCCGCTTCCCGGCCCTGCTGCAGGGAGCTCAAA
ATGGAGGACGCGGCGCTCGGGAGAGCGGGCGGGTGAGTCACC
CACACAAAGGAAAAGGGCCTTTCCGTCCTCAGCCGTCGCTTCA
TGTGACTCCACGGAGTACCGGGCGCCGTCCAGGCACCTCGATT
AGTTCTCGAGCTTTTGGAGTACGTCGTCTTTAGGTTGGGGGGAG
GGGTTTTATGCGATGGAGTTTCCCCACACTGAGTGGGTGGAGA
CTGAAGTTAGGCCAGCTTGGCACTTGATGTAATTCTCCTTGGAA
TTTGCCCTTTTTGAGTTTGGATCTTGGTTCATTCTCAAGCCTCAG
ACAGTGGTTCAAAGTTTTTTTCTTCCATTTCAGGTGTCGTGACC
ACCATGGCGCTTCCGGTGACAGCACTGCTCCTCCCCTTGGCGCT
GTTGCTCCACGCAGCAAGGCCGGACATCGTGATGACCCAGAGC
CCCCTGAGCCTGCCTGTGTCCCTGGGAGACCAGGCTTCCATCA
GCTGCAGGTCCACCCAGAGCCTGGTGCACTCCAACGGCAACAC
CCACCTGCACTGGTACCTGCAGAGGCCTGGCCAGTCCCCCAAG
CTGCTGATCTACAGCGTGAGCAATAGGTTCAGCGAGGTGCCCG
ACAGATTCAGCGCCAGCGGAAGCGGCACCGACTTCACCCTGAA
GATCAGCAGGGTCGAGGCCGAAGATCTGGGCGTGTACTTCTGC
TCCCAGACATCCCACATCCCTTACACCTTCGGCGGCGGCACCA
AGCTGGAGATTAAGGGCGGCGGAGGATCCGGCGGAGGAGGAT
CCGGAGGAGGAGGAAGCGAGGTGCAGCTGCAGCAGAGCGGAC
CCGAGCTGGTGAAACCCGGAGCCAGCGTCAAAATGAGCTGCA
AGGCCAGCGGCAACACCCTGACCAACTACGTCATCCACTGGAT
GAAGCAGATGCCCGGACAGGGCCTGGACTGGATCGGCTACATC
CTGCCCTACAACGACCTGACCAAGTACAACGAGAAATTCACCG
GCAAGGCCACCCTGACCAGCGACAAGAGCAGCAGCAGCGCCT
ACATGGAGCTGAACAGCCTGACCAGCGAGGACTCCGCCGTGTA
CTATTGCACCAGGTGGGACTGGGACGGCTTCTTTGACCCCTGG
GGCCAGGGCACAACACTCACCGTGAGCTCCAGTGCTGCTGCCT
TTGTCCCGGTATTTCTCCCAGCCAAACCGACCACGACTCCCGCC
CCGCGCCCTCCGACACCCGCTCCCACCATCGCCTCTCAACCTCT
TAGTCTTCGCCCCGAGGCATGCCGACCCGCCGCCGGGGGTGCT
GTTCATACGAGGGGCTTGGACTTCGCTTGTGATATTTACATTTG
GGCTCCGTTGGCGGGTACGTGCGGCGTCCTTTTGTTGTCACTCG
TTATTACTTTGTATTGTAATCACAGGAATCGCTCAAAGCGGAGT
AGGTTGTTGCATTCCGATTACATGAATATGACTCCTCGCCGGCC
TGGGCCGACAAGAAAACATTACCAACCCTATGCCCCCCACGA
GACTTCGCTGCGTACAGGTCCCGAGTGAAGTTTTCCCGAAGCG
CAGACGCTCCGGCATATCAGCAAGGACAGAATCAGCTGTATAA
CGAACTGAATTTGGGACGCCGCGAGGAGTATGACGTGCTTGAT
AAACGCCGGGGAGAGACCCGGAAATGGGGGGTAAACCCCGA
AGAAAGAATCCCCAAGAAGGACTCTACAATGAACTCCAGAAG
GATAAGATGGCGGAGGCCTACTCAGAAATAGGTATGAAGGGC
GAACGACGACGGGGAAAAGGTCACGATGGCCTCTACCAAGGG
TTGAGTACGGCAACCAAAGATACGTACGATGCACTGCATATGC
AGGCCCTGCCTCCCAGATAATAATAAAATCGCTATCCATCGAA
GATGGATGTGTGTTGGTTTTTTGTGTGTGGAGCAACAAATCTGA
CTTTGCATGTGCAAACGCCTTCAACAACAGCATTATTCCAGAA
GACACCTTCTTCCCCAGCCCAGGTAAGGGCAGCTTTGGTGCCTT
CGCAGGCTGTTTCCTTGCTTCAGGAATGGCCAGGTTCTGCCCAG
AGCTCTGGTCAATGATGTCTAAAACTCCTCTGATTGGTGGTCTC
GGCCTTATCCATTGCCACCAAAACCCTCTTTTTACTAAGAAACA
GTGAGCCTTGTTCTGGCAGTCCAGAGAATGACACGGGAAAAAA
GCAGATGAAGAGAAGGTGGCAGGAGAGGGCACGTGGCCCAGC
CTCAGTCTCTCCAACTGAGTTCCTGCCTGCCTGCCTTTGCTCAG
ACTGTTTGCCCCTTACTGCTCTTCTAGGCCTCATTCTAAGCCCCT
TCTCCAAGTTGCCTCTCCTTATTTCTCCCTGTCTGCCAAAAAAT
CTTTCCCAGCTCACTAAGTCAGTCTCACGCAGTCACTCATTAAC
CCACCAATCACTGATTGTGCCGGCACATGAATGCACCAGGTGT
TGAAGTGGAGGAATTAAAAAGTCAGATGAGGGGTGTGCCCAG
```

TABLE 34-continued rAAV Sequences

| SEQ ID NO: | Description | Sequence |
|---|---|---|
| | | AGGAAGCACCATTCTAGTTGGGGGAGCCCATCTGTCAGCTGGG |
| | | AAAAGTCCAAATAACTTCAGATTGGAATGTGTTTTAACTCAGG |
| | | GTTGAGAAAACAGCTACCTTCAGGACAAAAGTCAGGGAAGGG |
| | | CTCTCTGAAGAAATGCTACTTGAAGATACCAGCCCTACCAAGG |
| | | GCAGGGAGAGGACCCTATAGAGGCCTGGGACAGGAGCTCAAT |
| | | GAGAAAGGTAACCACGTGCGGACCGAGGCTGCAGCGTCGTCCT |
| | | CCCTAGGAACCCCTAGTGATGGAGTTGGCCACTCCCTCTCTGCG |
| | | CGCTCGCTCGCTCACTGAGGCCGGGCGACCAAAGGTCGCCCGA |
| | | CGCCCGGGCTTTGCCCGGGCGGCCTCAGTGAGCGAGCGAGCGC |
| | | GCAGCTGCCTGCAGG |
| 1372 | CTX-166 | CCTGCAGGCAGCTGCGCGCTCGCTCGCTCACTGAGGCCGCCCG |
| | | GGCGTCGGGCGACCTTTGGTCGCCCGGCCTCAGTGAGCGAGCG |
| | | AGCGCGCAGAGAGGGAGTGGCCAACTCCATCACTAGGGGTTCC |
| | | TGCGGCCGCACGCGTGAGATGTAAGGAGCTGCTGTGACTTGCT |
| | | CAAGGCCTTATATCGAGTAAACGGTAGTGCTGGGGCTTAGACG |
| | | CAGGTGTTCTGATTTATAGTTCAAAACCTCTATCAATGAGAGA |
| | | GCAATCTCCTGGTAATGTGATAGATTTCCCAACTTAATGCCAAC |
| | | ATACCATAAACCTCCCATTCTGCTAATGCCCAGCCTAAGTTGGG |
| | | GAGACCACTCCAGATTCCAAGATGTACAGTTTGCTTTGCTGGG |
| | | CCTTTTTCCCATGCCTGCCTTTACTCTGCCAGAGTTATATTGCTG |
| | | GGGTTTTGAAGAAGATCCTATTAAATAAAAGAATAAGCAGTAT |
| | | TATTAAGTAGCCCTGCATTTCAGGTTTCCTTGAGTGGCAGGCCA |
| | | GGCCTGGCCGTGAACGTTCACTGAAATCATGGCCTCTTGGCCA |
| | | AGATTGATAGCTTGTGCCTGTCCCTGAGTCCCAGTCCATCACGA |
| | | GCAGCTGGTTTCTAAGATGCTATTTCCCGTATAAAGCATGAGA |
| | | CCGTGACTTGCCAGCCCCACAGAGCCCCGCCCTTGTCCATCACT |
| | | GGCATCTGGACTCCAGCCTGGGTTGGGGCAAAGAGGGAAATG |
| | | AGATCATGTCCTAACCCTGATCCTCTTGTCCCACAGATATCCAG |
| | | AACCCTGACCCTGCCGTGTACCAGCTGAGAGACTCTAAATCCA |
| | | GTGACAAGTCTGTCTGCCTATTCACCGATTTTGATTCTCAAACA |
| | | AATGTGTCACAAAGTAAGGATTCTGATGTGTATATCACAGACA |
| | | AAACTGTGCTAGACATGAGGTCTATGGACTTCAGGCTCCGGTG |
| | | CCCGTCAGTGGGCAGAGCGCACATCGCCCACAGTCCCCGAGAA |
| | | GTTGGGGGGAGGGGTCGGCAATTGAACCGGTGCCTAGAGAAG |
| | | GTGGCGCGGGGTAAACTGGGAAAGTGATGTCGTGTACTGGCTC |
| | | CGCCTTTTTCCCGAGGGTGGGGGAGAACCGTATATAAGTGCAG |
| | | TAGTCGCCGTGAACGTTCTTTTTCGCAACGGGTTTGCCGCCAGA |
| | | ACACAGGTAAGTGCCGTGTGTGGTTCCCGCGGGCCTGGCCTCT |
| | | TTACGGGTTATGGCCCTTGCGTGCCTTGAATTACTTCCACTGGC |
| | | TGCAGTACGTGATTCTTGATCCCGAGCTTCGGGTTGGAAGTGG |
| | | GTGGGAGAGTTCGAGGCCTTGCGCTTAAGGAGCCCCTTCGCCT |
| | | CGTGCTTGAGTTGAGGCCTGGCCTGGGCGCTGGGGCCGCCGCG |
| | | TGCGAATCTGGTGGCACCTTCGCGCCTGTCTCGCTGCTTTCGAT |
| | | AAGTCTCTAGCCATTTAAAATTTTTGATGACCTGCTGCGACGCT |
| | | TTTTTTCTGGCAAGATAGTCTTGTAAATGCGGGCCAAGATCTGC |
| | | ACACTGGTATTTCGGTTTTTGGGGCCGCGGGCGGCGACGGGGC |
| | | CCGTGCGTCCCAGCGCACATGTTCGGCGAGGCGGGGCCTGCGA |
| | | GCGCGGCCACCGAGAATCGGACGGGGGTAGTCTCAAGCTGGCC |
| | | GGCCTGCTCTGGTGCCTGGCCTCGCGCCGCCGTGTATCGCCCCG |
| | | CCCTGGGCGGCAAGGCTGGCCCGGTCGGCACCAGTTGCGTGAG |
| | | CGGAAAGATGGCCGCTTCCCGGCCCTGCTGCAGGGAGCTCAAA |
| | | ATGGAGGACGCGGCGCTCGGGAGAGCGGGCGGGTGAGTCACC |
| | | CACACAAAGGAAAAGGGCCTTTCCGTCCTCAGCCGTCGCTTCA |
| | | TGTGACTCCACGGAGTACCGGGCGCCGTCCAGGCACCTCGATT |
| | | AGTTCTCGAGCTTTTGGAGTACGTCGTCTTTAGGTTGGGGGGAG |
| | | GGGTTTTATGCGATGGAGTTTCCCCACACTGAGTGGGTGGAGA |
| | | CTGAAGTTAGGCCAGCTTGGCACTTGATGTAATTCTCCTTGGAA |
| | | TTTGCCCTTTTTGAGTTTGGATCTTGGTTCATTCTCAAGCCTCAG |
| | | ACAGTGGTTCAAAGTTTTTTTCTTCCATTTCAGGTGTCGTGACC |
| | | ACCATGGCGCTTCCGGTGACAGCACTGCTCCTCCCCTTGGCGCT |
| | | GTTGCTCCACGCAGCAAGGCCGCAGGTGCAGCTGGTGCAGAGC |
| | | GGAGCCGAGCTCAAGAAGCCCGGAGCCTCCGTGAAGGTGAGC |
| | | TGCAAGGCCAGCGGCAACACCCTGACCAACTACGTGATCCACT |
| | | GGGTGAGACAAGCCCCCGGCCAAAGGCTGGAGTGGATGGGCT |
| | | ACATCCTGCCCTACAACGACCTGACCAAGTACAGCCAGAAGTT |
| | | CCAGGGCAGGGTGACCATCACCAGGGATAAGAGCGCCTCCACC |
| | | GCCTATATGGAGCTGAGCAGCCTGAGGAGCGAGGACACCGCTG |
| | | TGTACTACTGTACAAGGTGGGACTGGGACGGCTTCTTTGACCC |
| | | CTGGGGCCAGGGCACAACAGTGACCGTCAGCAGCGGCGGCGG |
| | | AGGCAGCGGCGGCGGCGGCAGCGGCGGAGGCGGAAGCGAAAT |
| | | CGTGATGACCCAGAGCCCCGCCACACTGAGCGTGAGCCCTGGC |
| | | GAGAGGGCCAGCATCTCCTGCAGGGCTAGCCAAAGCCTGGTGC |
| | | ACAGCAACGGCAACACCCACCTGCACTGGTACCAGCAGAGACC |
| | | CGGACAGGCTCCCAGGCTGCTGATCTACAGCGTGAGCAACAGG |
| | | TTCTCCGAGGTGCCTGCCAGGTTTAGCGGCAGCGGAAGCGGCA |

TABLE 34-continued rAAV Sequences

| SEQ ID NO: | Description | Sequence |
|---|---|---|
| | | CCGACTTTACCCTGACCATCAGCAGCGTGGAGTCCGAGGACTT |
| | | CGCCGTGTATTACTGCAGCCAGACCAGCCACATCCCTTACACCT |
| | | TCGGCGGCGGCACCAAGCTGGAGATCAAAAGTGCTGCTGCCTT |
| | | TGTCCCGGTATTTCTCCCAGCCAAACCGACCACGACTCCCGCCC |
| | | CGCGCCCTCCGACACCCGCTCCCACCATCGCCTCTCAACCTCTT |
| | | AGTCTTCGCCCCGAGGCATGCCGACCCGCCGCCGGGGGTGCTG |
| | | TTCATACGAGGGGCTTGGACTTCGCTTGTGATATTTACATTTGG |
| | | GCTCCGTTGGCGGGTACGTGCGGCGTCCTTTTGTTGTCACTCGT |
| | | TATTACTTTGTATTGTAATCACAGGAATCGCTCAAAGCGGAGT |
| | | AGGTTGTTGCATTCCGATTACATGAATATGACTCCTCGCCGGCC |
| | | TGGGCCGACAAGAAAACATTACCAACCCTATGCCCCCCCACGA |
| | | GACTTCGCTGCGTACAGGTCCCGAGTGAAGTTTTCCCGAAGCG |
| | | CAGACGCTCCGGCATATCAGCAAGGACAGAATCAGCTGTATAA |
| | | CGAACTGAATTTGGGACGCCGCGAGGAGTATGACGTGCTTGAT |
| | | AAACGCCGGGGAGAGACCCGGAAATGGGGGGTAAACCCCGA |
| | | AGAAAGAATCCCCAAGAAGGACTCTACAATGAACTCCAGAAG |
| | | GATAAGATGGCGGAGGCCTACTCAGAAATAGGTATGAAGGGC |
| | | GAACGACGACGGGGAAAAGGTCACGATGGCCTCTACCAAGGG |
| | | TTGAGTACGGCAACCAAAGATACGTACGATGCACTGCATATGC |
| | | AGGCCCTGCCTCCCAGATAATAATAAAATCGCTATCCATCGAA |
| | | GATGGATGTGTGTTGGTTTTTTGTGTGTGGAGCAACAAATCTGA |
| | | CTTTGCATGTGCAAACGCCTTCAACAACAGCATTATTCCAGAA |
| | | GACACCTTCTTCCCCAGCCCAGGTAAGGGCAGCTTTGGTGCCTT |
| | | CGCAGGCTGTTTCCTTGCTTCAGGAATGGCCAGGTTCTGCCCAG |
| | | AGCTCTGGTCAATGATGTCTAAAACTCCTCTGATTGGTGGTCTC |
| | | GGCCTTATCCATTGCCACCAAAACCCTCTTTTTACTAAGAAACA |
| | | GTGAGCCTTGTTCTGGCAGTCCAGAGAATGACACGGGAAAAAA |
| | | GCAGATGAAGAGAAGGTGGCAGGAGAGGGCACGTGGCCCAGC |
| | | CTCAGTCTCTCCAACTGAGTTCCTGCCTGCCTGCCTTTGCTCAG |
| | | ACTGTTTGCCCCTTACTGCTCTTCTAGGCCTCATTCTAAGCCCCT |
| | | TCTCCAAGTTGCCTCTCCTTATTTCTCCCTGTCTGCCAAAAAAT |
| | | CTTTCCCAGCTCACTAAGTCAGTCTCACGCAGTCACTCATTAAC |
| | | CCACCAATCACTGATTGTGCCGGCACATGAATGCACCAGGTGT |
| | | TGAAGTGGAGGAATTAAAAAGTCAGATGAGGGGTGTGCCCAG |
| | | AGGAAGCACCATTCTAGTTGGGGGAGCCCATCTGTCAGCTGGG |
| | | AAAAGTCCAAATAACTTCAGATTGGAATGTGTTTTAACTCAGG |
| | | GTTGAGAAAACAGCTACCTTCAGGACAAAAGTCAGGGAAGGG |
| | | CTCTCTGAAGAAATGCTACTTGAAGATACCAGCCCTACCAAGG |
| | | GCAGGGAGAGGACCCTATAGAGGCCTGGGACAGGAGCTCAAT |
| | | GAGAAAGGTAACCACGTGCGGACCGAGGCTGCAGCGTCGTCCT |
| | | CCCCTAGGAACCCCTAGTGATGGAGTTGGCCACTCCCTCTCTGCG |
| | | CGCTCGCTCGCTCACTGAGGCCGGGCGACCAAAGGTCGCCCGA |
| | | CGCCCGGGCTTTGCCCGGGCGGCCTCAGTGAGCGAGCGAGCGC |
| | | GCAGCTGCCTGCAGG |
| 1373 | CTX-1666 | CCTGCAGGCAGCTGCGCGCTCGCTCGCTCACTGAGGCCGCCCG |
| | | GGCGTCGGGCGACCTTTGGTCGCCCGGCCTCAGTGAGCGAGCG |
| | | AGCGCGCAGAGAGGGAGTGGCCAACTCCATCACTAGGGGTTCC |
| | | TGCGGCCGCACGCGTGAGATGTAAGGAGCTGCTGTGACTTGCT |
| | | CAAGGCCTTATATCGAGTAAACGGTAGTGCTGGGGCTTAGACG |
| | | CAGGTGTTCTGATTTATAGTTCAAAACCTCTATCAATGAGAGA |
| | | GCAATCTCCTGGTAATGTGATAGATTTCCCAACTTAATGCCAAC |
| | | ATACCATAAACCTCCCATTCTGCTAATGCCCAGCCTAAGTTGGG |
| | | GAGACCACTCCAGATTCCAAGATGTACAGTTTGCTTTGCTGGG |
| | | CCTTTTTCCCATGCCTGCCTTTACTCTGCCAGAGTTATATTGCTG |
| | | GGGTTTTGAAGAAGATCCTATTAAATAAAAGAATAAGCAGTAT |
| | | TATTAAGTAGCCCTGCATTTCAGGTTTCCTTGAGTGGCAGGCCA |
| | | GGCCTGGCCGTGAACGTTCACTGAAATCATGGCCTCTTGGCCA |
| | | AGATTGATAGCTTGTGCCTGTCCCTGAGTCCCAGTCCATCACGA |
| | | GCAGCTGGTTTCTAAGATGCTATTTCCCGTATAAAGCATGAGA |
| | | CCGTGACTTGCCAGCCCCACAGAGCCCCGCCCTTGTCCATCACT |
| | | GGCATCTGGACTCCAGCCTGGGTTGGGGCAAAGAGGGAAATG |
| | | AGATCATGTCCTAACCCTGATCCTCTTGTCCCACAGATATCCAG |
| | | AACCCTGACCCTGCCGTGTACCAGCTGAGAGACTCTAAATCCA |
| | | GTGACAAGTCTGTCTGCCTATTCACCGATTTTGATTCTCAAACA |
| | | AATGTGTCACAAAGTAAGGATTCTGATGTGTATATCACAGACA |
| | | AAACTGTGCTAGACATGAGGTCTATGGACTTCAGGCTCCGGTG |
| | | CCCGTCAGTGGGCAGAGCGCACATCGCCCACAGTCCCGAGAA |
| | | GTTGGGGGAGGGGTCGGCAATTGAACCGGTGCCTAGAGAAG |
| | | GTGGCGCGGGGTAAACTGGGAAAGTGATGTCGTGTACTGGCTC |
| | | CGCCTTTTTCCCGAGGGTGGGGAGAACCGTATATAAGTGCAG |
| | | TAGTCGCCGTGAACGTTCTTTTTCGCAACGGGTTTGCCGCCAGA |
| | | ACACAGGTAAGTGCCGTGTGTGGTTCCCGCGGGCCTGGCCTCT |
| | | TTACGGGTTATGGCCCTTGCGTGCCTTGAATTACTTCCACTGGC |
| | | TGCAGTACGTGATTCTTGATCCCGAGCTTCGGGTTGGAAGTGG |
| | | GTGGGAGAGTTCGAGGCCTTGCGCTTAAGGAGCCCCTTCGCCT |

TABLE 34-continued rAAV Sequences

SEQ ID NO:Description Sequence

```
CGTGCTTGAGTTGAGGCCTGGCCTGGGCGCTGGGGCCGCCGCG
TGCGAATCTGGTGGCACCTTCGCGCCTGTCTCGCTGCTTTCGAT
AAGTCTCTAGCCATTTAAAATTTTTGATGACCTGCTGCGACGCT
TTTTTTCTGGCAAGATAGTCTTGTAAATGCGGGCCAAGATCTGC
ACACTGGTATTTCGGTTTTTGGGGCCGCGGGCGGCGACGGGGC
CCGTGCGTCCCAGCGCACATGTTCGGCGAGGCGGGGCCTGCGA
GCGCGGCCACCGAGAATCGGACGGGGGTAGTCTCAAGCTGGCC
GGCCTGCTCTGGTGCCTGGCCTCGCGCCGCCGTGTATCGCCCCG
CCCTGGGCGGCAAGGCTGGCCCGGTCGGCACCAGTTGCGTGAG
CGGAAAGATGGCCGCTTCCCGGCCCTGCTGCAGGGAGCTCAAA
ATGGAGGACGCGGCGCTCGGGAGAGCGGGCGGGTGAGTCACC
CACACAAAGGAAAAGGGCCTTTCCGTCCTCAGCCGTCGCTTCA
TGTGACTCCACGGAGTACCGGGCGCCGTCCAGGCACCTCGATT
AGTTCTCGAGCTTTTGGAGTACGTCGTCTTTAGGTTGGGGGGAG
GGGTTTTATGCGATGGAGTTTCCCCACACTGAGTGGGTGGAGA
CTGAAGTTAGGCCAGCTTGGCACTTGATGTAATTCTCCTTGGAA
TTTGCCCTTTTTGAGTTTGGATCTTGGTTCATTCTCAAGCCTCAG
ACAGTGGTTCAAAGTTTTTTTCTTCCATTTCAGGTGTCGTGACC
ACCATGGCGCTTCCGGTGACAGCACTGCTCCTCCCCTTGGCGCT
GTTGCTCCACGCAGCAAGGCCGCAGGTGCAGCTGGTGCAGAGC
GGAGCCGAGCTCAAGAAGCCCGGAGCCTCCGTGAAGGTGAGC
TGCAAGGCCAGCGGCAACACCCTGACCAACTACGTGATCCACT
GGGTGAGACAAGCCCCCGGCCAAAGGCTGGAGTGGATGGGCT
ACATCCTGCCCTACAACGACCTGACCAAGTACAGCCAGAAGTT
CCAGGGCAGGGTGACCATCACCAGGGATAAGAGCGCCTCCACC
GCCTATATGGAGCTGAGCAGCCTGAGGAGCGAGGACACCGCTG
TGTACTACTGTACAAGGTGGGACTGGGACGGCTTCTTTGACCC
CTGGGGCCAGGGCACAACAGTGACCGTCAGCAGCGGCGGCGG
AGGCAGCGGCGGCGGCGGCAGCGGCGGAGGCGGAAGCGAAAT
CGTGATGACCCAGAGCCCCGCCACACTGAGCGTGAGCCCTGGC
GAGAGGGCCAGCATCTCCTGCAGGGCTAGCCAAAGCCTGGTGC
ACAGCAACGGCAACACCCACCTGCACTGGTACCAGCAGAGACC
CGGACAGGCTCCCAGGCTGCTGATCTACAGCGTGAGCAACAGG
TTCTCCGAGGTGCCTGCCAGGTTTAGCGGCAGCGGAAGCGGCA
CCGACTTTACCCTGACCATCAGCAGCGTGGAGTCCGAGGACTT
CGCCGTGTATTACTGCAGCCAGACCAGCCACATCCCTTACACCT
TCGGCGGCGGCACCAAGCTGGAGATCAAAAGTGCTGCTGCCTT
TGTCCCGGTATTTCTCCCAGCCAAACCGACCACGACTCCCGCCC
CGCGCCCTCCGACACCCGCTCCCACCATCGCCTCTCAACCTCTT
AGTCTTCGCCCCGAGGCATGCCGACCCGCCGCCGGGGGTGCTG
TTCATACGAGGGGCTTGGACTTCGCTTGTGATATTTACATTTGG
GCTCCGTTGGCGGGTACGTGCGGCGTCCTTTTGTTGTCACTCGT
TATTACTTTGTATTGTAATCACAGGAATCGCAAACGGGGCAGA
AAGAAACTCCTGTATATATTCAAACAACCATTTATGAGACCAG
TACAAACTACTCAAGAGGAAGATGGCTGTAGCTGCCGATTTCC
AGAAGAAGAAGAAGGAGGATGTGAACTGCGAGTGAAGTTTTC
CCGAAGCGCAGACGCTCCGGCATATCAGCAAGGACAGAATCA
GCTGTATAACGAACTGAATTTGGGACGCCGCGAGGAGTATGAC
GTGCTTGATAAACGCCGGGGAGAGACCCGGAAATGGGGGGT
AAACCCCGAAGAAAGAATCCCCAAGAAGGACTCTACAATGAA
CTCCAGAAGGATAAGATGGCGGAGGCCTACTCAGAAATAGGT
ATGAAGGGCGAACGACGACGGGGAAAAGGTCACGATGGCCTC
TACCAAGGGTTGAGTACGGCAACCAAAGATACGTACGATGCAC
TGCATATGCAGGCCCTGCCTCCCAGATAATAATAAAATCGCTA
TCCATCGAAGATGGATGTGTGTTGGTTTTTTGTGTGTGGAGCAA
CAAATCTGACTTTGCATGTGCAAACGCCTTCAACAACAGCATT
ATTCCAGAAGACACCTTCTTCCCCAGCCCAGGTAAGGGCAGCT
TTGGTGCCTTCGCAGGCTGTTTCCTTGCTTCAGGAATGGCCAGG
TTCTGCCCAGAGCTCTGGTCAATGATGTCTAAAACTCCTCTGAT
TGGTGGTCTCGGCCTTATCCATTGCCACCAAAACCCTCTTTTTA
CTAAGAAACAGTGAGCCTTGTTCTGGCAGTCCAGAGAATGACA
CGGGAAAAAAGCAGATGAAGAGAAGGTGGCAGGAGAGGGCA
CGTGGCCCAGCCTCAGTCTCTCCAACTGAGTTCCTGCCTGCCTG
CCTTTGCTCAGACTGTTTGCCCCTTACTGCTCTTCTAGGCCTCAT
TCTAAGCCCCTTCTCCAAGTTGCCTCTCCTTATTTCTCCCTGTCT
GCCAAAAAATCTTTCCCAGCTCACTAAGTCAGTCTCACGCAGT
CACTCATTAACCCACCAATCACTGATTGTGCCGGCACATGAAT
GCACCAGGTGTTGAAGTGGAGGAATTAAAAAGTCAGATGAGG
GGTGTGCCCAGAGGAAGCACCATTCTAGTTGGGGGAGCCCATC
TGTCAGCTGGGAAAAGTCCAAATAACTTCAGATTGGAATGTGT
TTTAACTCAGGGTTGAGAAAACAGCTACCTTCAGGACAAAAGT
CAGGGAAGGGCTCTCTGAAGAAATGCTACTTGAAGATACCAGC
CCTACCAAGGGCAGGGAGGGACCCTATAGAGGCCTGGGACA
GGAGCTCAATGAGAAAGGTAACCACGTGCGGACCGAGGCTGC
AGCGTCGTCCTCCCTAGGAACCCCTAGTGATGGAGTTGGCCAC
TCCCTCTCTGCGCGCTCGCTCGCTCACTGAGGCCGGGCGACCA
```

TABLE 34-continued rAAV Sequences

| SEQ ID NO: | Description | Sequence |
|---|---|---|
| | | AAGGTCGCCCGACGCCCGGGCTTTGCCCGGGCGGCCTCAGTGA
GCGAGCGAGCGCGCAGCTGCCTGCAGG |
| 1374 | CTX-167 | CCTGCAGGCAGCTGCGCGCTCGCTCGCTCACTGAGGCCGCCCG
GGCGTCGGGCGACCTTTGGTCGCCCGGCCTCAGTGAGCGAGCG
AGCGCGCAGAGAGGGAGTGGCCAACTCCATCACTAGGGGTTCC
TGCGGCCGCACGCGTGAGATGTAAGGAGCTGCTGTGACTTGCT
CAAGGCCTTATATCGAGTAAACGGTAGTGCTGGGGCTTAGACG
CAGGTGTTCTGATTTATAGTTCAAAACCTCTATCAATGAGAGA
GCAATCTCCTGGTAATGTGATAGATTTCCCAACTTAATGCCAAC
ATACCATAAACCTCCCATTCTGCTAATGCCCAGCCTAAGTTGGG
GAGACCACTCCAGATTCCAAGATGTACAGTTTGCTTTGCTGGG
CCTTTTTCCCATGCCTGCCTTTACTCTGCCAGAGTTATATTGCTG
GGGTTTTGAAGAAGATCCTATTAAATAAAAGAATAAGCAGTAT
TATTAAGTAGCCCTGCATTTCAGGTTTCCTTGAGTGGCAGGCCA
GGCCTGGCCGTGAACGTTCACTGAAATCATGGCCTCTTGGCCA
AGATTGATAGCTTGTGCCTGTCCCTGAGTCCCAGTCCATCACGA
GCAGCTGGTTTCTAAGATGCTATTTCCCGTATAAAGCATGAGA
CCGTGACTTGCCAGCCCCACAGAGCCCCGCCCTTGTCCATCACT
GGCATCTGGACTCCAGCCTGGGTTGGGGCAAAGAGGGAAATG
AGATCATGTCCTAACCCTGATCCTCTTGTCCCACAGATATCCAG
AACCCTGACCCTGCCGTGTACCAGCTGAGAGACTCTAAATCCA
GTGACAAGTCTGTCTGCCTATTCACCGATTTTGATTCTCAAACA
AATGTGTCACAAAGTAAGGATTCTGATGTGTATATCACAGACA
AAACTGTGCTAGACATGAGGTCTATGGACTTCAGGCTCCGGTG
CCCGTCAGTGGGCAGAGCGCACATCGCCCACAGTCCCCGAGAA
GTTGGGGGGAGGGGTCGGCAATTGAACCGGTGCCTAGAGAAG
GTGGCGCGGGGTAAACTGGGAAAGTGATGTCGTGTACTGGCTC
CGCCTTTTTCCCGAGGGTGGGGGAGAACCGTATATAAGTGCAG
TAGTCGCCGTGAACGTTCTTTTTCGCAACGGGTTTGCCGCCAGA
ACACAGGTAAGTGCCGTGTGTGGTTCCCGCGGGCCTGGCCTCT
TTACGGGTTATGGCCCTTGCGTGCCTTGAATTACTTCCACTGGC
TGCAGTACGTGATTCTTGATCCCGAGCTTCGGGTTGGAAGTGG
GTGGGAGAGTTCGAGGCCTTGCGCTTAAGGAGCCCCTTCGCCT
CGTGCTTGAGTTGAGGCCTGGCCTGGGCGCTGGGGCCGCCGCG
TGCGAATCTGGTGGCACCTTCGCGCCTGTCTCGCTGCTTTCGAT
AAGTCTCTAGCCATTTAAAATTTTTGATGACCTGCTGCGACGCT
TTTTTTCTGGCAAGATAGTCTTGTAAATGCGGGCCAAGATCTGC
ACACTGGTATTTCGGTTTTTGGGGCCGCGGGCGGCGACGGGGC
CCGTGCGTCCCAGCGCACATGTTCGGCGAGGCGGGGCCTGCGA
GCGCGGCCACCGAGAATCGGACGGGGGTAGTCTCAAGCTGGCC
GGCCTGCTCTGGTGCCTGGCCTCGCGCCGCCGTGTATCGCCCCG
CCCTGGGCGGCAAGGCTGGCCCGGTCGGCACCAGTTGCGTGAG
CGGAAAGATGGCCGCTTCCCGGCCCTGCTGCAGGGGAGCTCAAA
ATGGAGGACGCGCGCTCGGGAGAGCGGGCGGGTGAGTCACC
CACACAAAGGAAAAGGGCCTTTCCGTCCTCAGCCGTCGCTTCA
TGTGACTCCACGGAGTACCGGGCGCCGTCCAGGCACCTCGATT
AGTTCTCGAGCTTTTGGAGTACGTCGTCTTTAGGTTGGGGGGAG
GGGTTTTATGCGATGGAGTTTCCCCACACTGAGTGGGTGGAGA
CTGAAGTTAGGCCAGCTTGGCACTTGATGTAATTCTCCTTGGAA
TTTGCCCTTTTTGAGTTTGGATCTTGGTTCATTCTCAAGCCTCAG
ACAGTGGTTCAAAGTTTTTTTCTTCCATTTCAGGTGTCGTGACC
ACCATGGCGCTTCCGGTGACAGCACTGCTCCTCCCCTTGGCGCT
GTTGCTCCACGCAGCAAGGCCGCAGGTGCAGCTGGTGCAGAGC
GGCGCCGAGCTGAAGAAACCTGGCGCCAGCGTCAAGGTGAGC
TGCAAGGCTTCCGGAAACACCCTCACCAACTACGTGATCCACT
GGGTGAGGCAGGCCCCCGGACAGAGACTGGAGTGGATGGGCT
ACATTCTGCCCTACAACGACCTGACCAAGTACAGCCAGAAGTT
CCAGGGCAGGGTCACCATCACCAGGGACAAGAGCGCCAGCAC
CGCCTACATGGAGCTGAGCAGCCTGAGGTCCGAGGACACAGCC
GTGTACTACTGCACCAGGTGGGACTGGGACGGATTCTTCGACC
CTTGGGGCCAAGGCACCACAGTGACAGTGAGCTCCGGCGGAG
GCGGCAGCGGCGGCGGAGGAAGCGGCGGCGGCGGAAGCGACA
TCGTGATGACCCAGAGCCCTCTGAGCCTGCCCGTGACACTGGG
ACAGCCTGCCACACTGTCCTGCAGGAGCACCCAGAGCCTGGTG
CATAGCAACGGCAACACCCACCTGCACTGGTTCCAGCAGAGAC
CTGGCCAGAGCCCCCTGAGACTGATCTACAGCGTGAGCAACGA
GGACAGCGGCGTGCCCGATAGATTTAGCGGCAGCGGCAGCGG
CACCGACTTTACCCTGAAAATCTCCAGGGTGGAGGCCGAGGAT
GTGGGCGTGTATTACTGCTCCCAGACAAGCCACATTCCCTATAC
ATTCGGCGGCGGCACCAAGCTGGAGATCAAGAGTGCTGCGCC
TTTGTCCCGGTATTTCTCCCAGCCAAACCGACCACGACTCCCGC
CCCGCGCCCTCCGACACCCGCTCCCACCATCGCCTCTCAACCTC
TTAGTCTTCGCCCCGAGGCATGCCGACCCGCCGCCGGGGGTGC
TGTTCATACGAGGGGCTTGGACTTCGCTTGTGATATTTACATTT
GGGCTCCGTTGGCGGGTACGTGCGGCGTCCTTTTGTTGTCACTC |

TABLE 34-continued rAAV Sequences

| SEQ ID NO: | Description | Sequence |
|---|---|---|
| | | GTTATTACTTTGTATTGTAATCACAGGAATCGCTCAAAGCGGA |
| | | GTAGGTTGTTGCATTCCGATTACATGAATATGACTCCTCGCCGG |
| | | CCTGGGCCGACAAGAAAACATTACCAACCCTATGCCCCCCCAC |
| | | GAGACTTCGCTGCGTACAGGTCCCGAGTGAAGTTTTCCCGAAG |
| | | CGCAGACGCTCCGGCATATCAGCAAGGACAGAATCAGCTGTAT |
| | | AACGAACTGAATTTGGGACGCCGCGAGGAGTATGACGTGCTTG |
| | | ATAAACGCCGGGGAGAGACCCGGAAATGGGGGTAAACCCC |
| | | GAAGAAAGAATCCCCAAGAAGGACTCTACAATGAACTCCAGA |
| | | AGGATAAGATGGCGGAGGCCTACTCAGAAATAGGTATGAAGG |
| | | GCGAACGACGACGGGGAAAAGGTCACGATGGCCTCTACCAAG |
| | | GGTTGAGTACGGCAACCAAAGATACGTACGATGCACTGCATAT |
| | | GCAGGCCCTGCCTCCCAGATAATAATAAAATCGCTATCCATCG |
| | | AAGATGGATGTGTGTTGGTTTTTTGTGTGTGGAGCAACAAATCT |
| | | GACTTTGCATGTGCAAACGCCTTCAACAACAGCATTATTCCAG |
| | | AAGACACCTTCTTCCCCAGCCCAGGTAAGGGCAGCTTTGGTGC |
| | | CTTCGCAGGCTGTTTCCTTGCTTCAGGAATGGCCAGGTTCTGCC |
| | | CAGAGCTCTGGTCAATGATGTCTAAAACTCCTCTGATTGGTGGT |
| | | CTCGGCCTTATCCATTGCCACCAAAACCCTCTTTTTACTAAGAA |
| | | ACAGTGAGCCTTGTTCTGGCAGTCCAGAGAATGACACGGGAAA |
| | | AAAGCAGATGAAGAGAAGGTGGCAGGAGAGGGCACGTGGCCC |
| | | AGCCTCAGTCTCTCCAACTGAGTTCCTGCCTGCCTGCCTTTGCT |
| | | CAGACTGTTTGCCCCTTACTGCTCTTCTAGGCCTCATTCTAAGC |
| | | CCCTTCTCCAAGTTGCCTCTCCTTATTTCTCCCTGTCTGCCAAAA |
| | | AATCTTTCCCAGCTCACTAAGTCAGTCTCACGCAGTCACTCATT |
| | | AACCCACCAATCACTGATTGTGCCGGCACATGAATGCACCAGG |
| | | TGTTGAAGTGGAGGAATTAAAAAGTCAGATGAGGGGTGTGCCC |
| | | AGAGGAAGCACCATTCTAGTTGGGGGAGCCCATCTGTCAGCTG |
| | | GGAAAAGTCCAAATAACTTCAGATTGGAATGTGTTTTAACTCA |
| | | GGGTTGAGAAAACAGCTACCTTCAGGACAAAAGTCAGGGAAG |
| | | GGCTCTCTGAAGAAATGCTACTTGAAGATACCAGCCCTACCAA |
| | | GGGCAGGGAGAGGACCCTATAGAGGCCTGGGACAGGAGCTCA |
| | | ATGAGAAAGGTAACCACGTGCGGACCGAGGCTGCAGCGTCGTC |
| | | CTCCCTAGGAACCCCTAGTGATGGAGTTGGCCACTCCCTCTCTG |
| | | CGCGCTCGCTCGCTCACTGAGGCCGGGCGACCAAAGGTCGCCC |
| | | GACGCCCGGGCTTTGCCCGGGCGGCCTCAGTGAGCGAGCGAGC |
| | | GCGCAGCTGCCTGCAGG |
| 1375 | CTX-168 | CCTGCAGGCAGCTGCGCGCTCGCTCGCTCACTGAGGCCGCCCG |
| | | GGCGTCGGGCGACCTTTGGTCGCCCGGCCTCAGTGAGCGAGCG |
| | | AGCGCGCAGAGAGGGAGTGGCCAACTCCATCACTAGGGGTTCC |
| | | TGCGGCCGCACGCGTGAGATGTAAGGAGCTGCTGTGACTTGCT |
| | | CAAGGCCTTATATCGAGTAAACGGTAGTGCTGGGGCTTAGACG |
| | | CAGGTGTTCTGATTTATAGTTCAAAACCTCTATCAATGAGAGA |
| | | GCAATCTCCTGGTAATGTGATAGATTTCCCAACTTAATGCCAAC |
| | | ATACCATAAACCTCCCATTCTGCTAATGCCCAGCCTAAGTTGGG |
| | | GAGACCACTCCAGATTCCAAGATGTACAGTTTGCTTTGCTGGG |
| | | CCTTTTTCCCATGCCTGCCTTTACTCTGCCAGAGTTATATTGCTG |
| | | GGGTTTTGAAGAAGATCCTATTAAATAAAAGAATAAGCAGTAT |
| | | TATTAAGTAGCCCTGCATTTCAGGTTTCCTTGAGTGGCAGGCCA |
| | | GGCCTGGCCGTGAACGTTCACTGAAATCATGGCCTCTTGGCCA |
| | | AGATTGATAGCTTGTGCCTGTCCCTGAGTCCCAGTCCATCACGA |
| | | GCAGCTGGTTTCTAAGATGCTATTTCCCGTATAAAGCATGAGA |
| | | CCGTGACTTGCCAGCCCCACAGAGCCCCGCCCTTGTCCATCACT |
| | | GGCATCTGGACTCCAGCCTGGGTTGGGGCAAAGAGGGAAATG |
| | | AGATCATGTCCTAACCCTGATCCTCTTGTCCCACAGATATCCAG |
| | | AACCCTGACCCTGCCGTGTACCAGCTGAGAGACTCTAAATCCA |
| | | GTGACAAGTCTGTCTGCCTATTCACCGATTTTGATTCTCAAACA |
| | | AATGTGTCACAAAGTAAGGATTCTGATGTGTATATCACAGACA |
| | | AAACTGTGCTAGACATGAGGTCTATGGACTTCAGGCTCCGGTG |
| | | CCCGTCAGTGGGCAGAGCGCACATCGCCCACAGTCCCGAGAA |
| | | GTTGGGGGAGGGGTCGGCAATTGAACCGGTGCCTAGAGAAG |
| | | GTGGCGCGGGGTAAACTGGGAAAGTGATGTCGTGTACTGGCTC |
| | | CGCCTTTTTCCCGAGGGTGGGGGAGAACCGTATATAAGTGCAG |
| | | TAGTCGCCGTGAACGTTCTTTTTCGCAACGGGTTTGCCGCCAGA |
| | | ACACAGGTAAGTGCCGTGTGTGGTTCCCGCGGGCCTGGCCTCT |
| | | TTACGGGTTATGGCCCTTGCGTGCCTTGAATTACTTCCACTGGC |
| | | TGCAGTACGTGATTCTTGATCCCGAGCTTCGGGTTGGAAGTGG |
| | | GTGGGAGAGTTCGAGGCCTTGCGCTTAAGGAGCCCCTTCGCCT |
| | | CGTGCTTGAGTTGAGGCCTGGCCTGGGCGCTGGGGCCGCCGCG |
| | | TGCGAATCTGGTGGCACCTTCGCGCCTGTCTCGCTGCTTTCGAT |
| | | AAGTCTCTAGCCATTTAAAATTTTTGATGACCTGCTGCGACGCT |
| | | TTTTTTCTGGCAAGATAGTCTTGTAAATGCGGGCCAAGATCTGC |
| | | ACACTGGTATTTCGGTTTTTGGGGCCGCGGGCGGCGACGGGGC |
| | | CCGTGCGTCCCAGCGCACATGTTCGGCGAGGCGGGGCCTGCGA |
| | | GCGCGGCCACCGAGAATCGGACGGGGGTAGTCTCAAGCTGGCC |
| | | GGCCTGCTCTGGTGCCTGGCCTCGCGCCGCCGTGTATCGCCCCG |

TABLE 34-continued rAAV Sequences

| SEQ ID NO | Description | Sequence |
|---|---|---|
| | | CCCTGGGCGGCAAGGCTGGCCCGGTCGGCACCAGTTGCGTGAG<br>CGGAAAGATGGCCGCTTCCCGGCCCTGCTGCAGGGAGCTCAAA<br>ATGGAGGACGCGGCGCTCGGGAGAGCGGGCGGGTGAGTCACC<br>CACACAAAGGAAAAGGGCCTTTCCGTCCTCAGCCGTCGCTTCA<br>TGTGACTCCACGGAGTACCGGGCGCCGTCCAGGCACCTCGATT<br>AGTTCTCGAGCTTTTGGAGTACGTCGTCTTTAGGTTGGGGGGAG<br>GGGTTTTATGCGATGGAGTTTCCCCACACTGAGTGGGTGGAGA<br>CTGAAGTTAGGCCAGCTTGGCACTTGATGTAATTCTCCTTGGAA<br>TTTGCCCTTTTTGAGTTTGGATCTTGGTTCATTCTCAAGCCTCAG<br>ACAGTGGTTCAAAGTTTTTTTCTTCCATTTCAGGTGTCGTGACC<br>ACCATGGCGCTTCCGGTGACAGCACTGCTCCTCCCCTTGGCGCT<br>GTTGCTCCACGCAGCAAGGCCGGAAATCGTGATGACCCAGAGC<br>CCTGCCACACTGAGCGTGAGCCCTGGCGAGAGAGCCAGCATCA<br>GCTGCAGGGCCTCCCAGAGCCTGGTGCACTCCAACGGCAATAC<br>CCACCTGCACTGGTATCAGCAGAGACCCGGCCAGGCCCCTAGG<br>CTGCTGATCTACTCCGTGAGCAACAGGTTCTCCGAGGTGCCCG<br>CCAGATTCAGCGGATCCGGCAGCGGCACCGACTTCACCCTCAC<br>CATCTCCAGCGTGGAGAGCGAGGACTTCGCCGTCTACTACTGC<br>AGCCAGACAAGCCACATCCCTACACCTTCGGCGGCGGCACCA<br>AGCTGGAGATCAAGGGCGGCGGCGGCAGCGGCGGCGGAGGCA<br>GCGGAGGCGGCGGATCCCAGGTGCAACTGGTGCAGAGCGGAG<br>CCGAGCTGAAGAAGCCCGGAGCCAGCGTGAAGGTCAGCTGCA<br>AGGCCAGCGGCAACACCCTGACAAACTACGTGATCCACTGGGT<br>GAGGCAGGCCCCTGGCCAAAGGCTCGAGTGGATGGGCTACATC<br>CTCCCCTACAACGACCTGACCAAGTACTCCCAGAAGTTCCAGG<br>GCAGGGTGACCATCACCAGGGATAAGAGCGCCAGCACCGCCT<br>ACATGGAACTCAGCAGCCTGAGGAGCGAGGACACCGCCGTGT<br>ACTACTGCACCAGGTGGGACTGGGATGGCTTCTTCGACCCTTG<br>GGGCCAGGGCACCACCGTGACAGTGAGCTCCAGTGCTGCTGCC<br>TTTGTCCCGGTATTTCTCCCAGCCAAACCGACCACGACTCCCGC<br>CCCGCGCCCTCCGACACCCGCTCCCACCATCGCCTCTCAACCTC<br>TTAGTCTTCGCCCCGAGGCATGCCGACCCGCCGCCGGGGGTGC<br>TGTTCATACGAGGGGCTTGGACTTCGCTTGTGATATTTACATTT<br>GGGCTCCGTTGGCGGGTACGTGCGGCGTCCTTTTGTTGTCACTC<br>GTTATTACTTTGTATTGTAATCACAGGAATCGCTCAAAGCGGA<br>GTAGGTTGTTGCATTCCGATTACATGAATATGACTCCTCGCCGG<br>CCTGGGCCGACAAGAAAACATTACCAACCCTATGCCCCCCCAC<br>GAGACTTCGCTGCGTACAGGTCCCGAGTGAAGTTTTCCCGAAG<br>CGCAGACGCTCCGGCATATCAGCAAGGACAGAATCAGCTGTAT<br>AACGAACTGAATTTGGGACGCCGCGAGGAGTATGACGTGCTTG<br>ATAAACGCCGGGGAGAGACCCGGAAATGGGGGTAAACCCC<br>GAAGAAAGAATCCCCAAGAAGGACTCTACAATGAACTCCAGA<br>AGGATAAGATGGCGGAGGCCTACTCAGAAATAGGTATGAAGG<br>GCGAACGACGACGGGGAAAAGGTCACGATGGCCTCTACCAAG<br>GGTTGAGTACGGCAACCAAAGATACGTACGATGCACTGCATAT<br>GCAGGCCCTGCCTCCCAGATAATAATAAAATCGCTATCCATCG<br>AAGATGGATGTGTGTTGGTTTTTTGTGTGTGGAGCAACAAATCT<br>GACTTTGCATGTGCAAACGCCTTCAACAACAGCATTATTCCAG<br>AAGACACCTTCTTCCCCAGCCCAGGTAAGGGCAGCTTTGGTGC<br>CTTCGCAGGCTGTTTCCTTGCTTCAGGAATGGCCAGGTTCTGCC<br>CAGAGCTCTGGTCAATGATGTCTAAAACTCCTCTGATTGGTGGT<br>CTCGGCCTTATCCATTGCCACCAAAACCCTCTTTTTACTAAGAA<br>ACAGTGAGCCTTGTTCTGGCAGTCCAGAGAATGACACGGGAAA<br>AAAGCAGATGAAGAGAAGGTGGCAGGAGAGGGCACGTGGCCC<br>AGCCTCAGTCTCTCCAACTGAGTTCCTGCCTGCCTGCCTTTGCT<br>CAGACTGTTTGCCCCTTACTGCTCTTCTAGGCCTCATTCTAAGC<br>CCCTTCTCCAAGTTGCCTCTCCTTATTTCTCCCTGTCTGCCAAAA<br>AATCTTTCCCAGCTCACTAAGTCAGTCTCACGCAGTCACTCATT<br>AACCCACCAATCACTGATTGTGCCGGCACATGAATGCACCAGG<br>TGTTGAAGTGGAGGAATTAAAAAGTCAGATGAGGGGTGTGCCC<br>AGAGGAAGCACCATTCTAGTTGGGGGAGCCCATCTGTCAGCTG<br>GGAAAAGTCCAAATAACTTCAGATTGGAATGTGTTTTAACTCA<br>GGGTTGAGAAAACAGCTACCTTCAGGACAAAAGTCAGGGAAG<br>GGCTCTCTGAAGAAATGCTACTTGAAGATACCAGCCCTACCAA<br>GGGCAGGGAGAGGACCCTATAGAGGCCTGGGACAGGAGCTCA<br>ATGAGAAAGGTAACCACGTGCGGACCGAGGCTGCAGCGTCGTC<br>CTCCCTAGGAACCCCTAGTGATGGAGTTGGCCACTCCCTCTCTG<br>CGCGCTCGCTCGCTCACTGAGGCCGGGCGACCAAAGGTCGCCC<br>GACGCCCGGGCTTTGCCCGGGCGGCCTCAGTGAGCGAGCGAGC<br>GCGCAGCTGCCTGCAGG |
| 1376 | CTX-169 | CCTGCAGGCAGCTGCGCGCTCGCTCGCTCACTGAGGCCGCCCG<br>GGCGTCGGGCGACCTTTGGTCGCCCGGCCTCAGTGAGCGAGCG<br>AGCGCGCAGAGAGGGAGTGGCCAACTCCATCACTAGGGGTTCC<br>TGCGGCCGCACGCGTGAGATGTAAGGAGCTGCTGTGACTTGCT<br>CAAGGCCTTATATCGAGTAAACGGTAGTGCTGGGGCTTAGACG |

TABLE 34-continued rAAV Sequences

SEQ ID NO:Description Sequence

CAGGTGTTCTGATTTATAGTTCAAAACCTCTATCAATGAGAGA
GCAATCTCCTGGTAATGTGATAGATTTCCCAACTTAATGCCAAC
ATACCATAAACCTCCCATTCTGCTAATGCCCAGCCTAAGTTGGG
GAGACCACTCCAGATTCCAAGATGTACAGTTTGCTTTGCTGGG
CCTTTTTCCCATGCCTGCCTTTACTCTGCCAGAGTTATATTGCTG
GGGTTTTGAAGAAGATCCTATTAAATAAAAGAATAAGCAGTAT
TATTAAGTAGCCCTGCATTTCAGGTTTCCTTGAGTGGCAGGCCA
GGCCTGGCCGTGAACGTTCACTGAAATCATGGCCTCTTGGCCA
AGATTGATAGCTTGTGCCTGTCCCTGAGTCCCAGTCCATCACGA
GCAGCTGGTTTCTAAGATGCTATTTCCCGTATAAAGCATGAGA
CCGTGACTTGCCAGCCCCACAGAGCCCCGCCCTTGTCCATCACT
GGCATCTGGACTCCAGCCTGGGTTGGGGCAAAGAGGGAAATG
AGATCATGTCCTAACCCTGATCCTCTTGTCCCACAGATATCCAG
AACCCTGACCCTGCCGTGTACCAGCTGAGAGACTCTAAATCCA
GTGACAAGTCTGTCTGCCTATTCACCGATTTTGATTCTCAAACA
AATGTGTCACAAAGTAAGGATTCTGATGTGTATATCACAGACA
AAACTGTGCTAGACATGAGGTCTATGGACTTCAGGCTCCGGTG
CCCGTCAGTGGGCAGAGCGCACATCGCCCACAGTCCCCGAGAA
GTTGGGGGGAGGGGTCGGCAATTGAACCGGTGCCTAGAGAAG
GTGGCGCGGGGTAAACTGGGAAAGTGATGTCGTGTACTGGCTC
CGCCTTTTTCCCGAGGGTGGGGGAGAACCGTATATAAGTGCAG
TAGTCGCCGTGAACGTTCTTTTTCGCAACGGGTTTGCCGCCAGA
ACACAGGTAAGTGCCGTGTGTGGTTCCCGCGGGCCTGGCCTCT
TTACGGGTTATGGCCCTTGCGTGCCTTGAATTACTTCCACTGGC
TGCAGTACGTGATTCTTGATCCCGAGCTTCGGGTTGGAAGTGG
GTGGGAGAGTTCGAGGCCTTGCGCTTAAGGAGCCCCTTCGCCT
CGTGCTTGAGTTGAGGCCTGGCCTGGGCGCTGGGGCCGCCGCG
TGCGAATCTGGTGGCACCTTCGCGCCTGTCTCGCTGCTTTCGAT
AAGTCTCTAGCCATTTAAAATTTTTGATGACCTGCTGCGACGCT
TTTTTTCTGGCAAGATAGTCTTGTAAATGCGGGCCAAGATCTGC
ACACTGGTATTTCGGTTTTTGGGGCCGCGGGCGGCGACGGGGC
CCGTGCGTCCCAGCGCACATGTTCGGCGAGGCGGGGCCTGCGA
GCGCGGCCACCGAGAATCGGACGGGGGTAGTCTCAAGCTGGCC
GGCCTGCTCTGGTGCCTGGCCTCGCGCCGCCGTGTATCGCCCCG
CCCTGGGCGGCAAGGCTGGCCCGGTCGGCACCAGTTGCGTGAG
CGGAAAGATGGCCGCTTCCCGGCCCTGCTGCAGGGAGCTCAAA
ATGGAGGACGCGGCGCTCGGGAGAGCGGGCGGGTGAGTCACC
CACACAAAGGAAAAGGGCCTTTCCGTCCTCAGCCGTCGCTTCA
TGTGACTCCACGGAGTACCGGGCGCCGTCCAGGCACCTCGATT
AGTTCTCGAGCTTTTGGAGTACGTCGTCTTTAGGTTGGGGGGAG
GGGTTTTATGCGATGGAGTTTCCCCACACTGAGTGGGTGGAGA
CTGAAGTTAGGCCAGCTTGGCACTTGATGTAATTCTCCTTGGAA
TTTGCCCTTTTTGAGTTTGGATCTTGGTTCATTCTCAAGCCTCAG
ACAGTGGTTCAAAGTTTTTTTCTTCCATTTCAGGTGTCGTGACC
ACCATGGCGCTTCCGGTGACAGCACTGCTCCTCCCCTTGGCGCT
GTTGCTCCACGCAGCAAGGCCGGACATCGTGATGACACAATCC
CCCCTCAGCCTGCCTGTGACACTGGGCCAGCCTGCCACCCTGA
GCTGCAGGAGCACCCAGTCCCTGGTGCACTCCAACGGCAACAC
CCACCTGCACTGGTTCCAGCAGAGGCCTGGACAGAGCCCCCTG
AGGCTGATCTACAGCGTGAGCAACAGGGACTCCGGCGTGCCCG
ATAGATTCAGCGGCAGCGGCTCCGGCACCGATTTCACCCTGAA
GATCTCCAGAGTGGAAGCCGAGGACGTGGGCGTCTACTACTGC
AGCCAGACCAGCCATATCCCCTACACCTTCGGCGGCGGCACCA
AGCTGGAGATCAAGGGAGGCGGCGGAAGCGGCGGAGGCGGAT
CCGGAGGCGGAGGCTCCCAAGTGCAGCTGGTGCAGAGCGGCG
CTGAGCTGAAGAAGCCCGGAGCCAGCGTGAAGGTGAGCTGCA
AGGCCAGCGGAAACACCCTGACCAACTACGTGATCCACTGGGT
GAGACAGGCCCCCGGACAGAGACTCGAGTGGATGGGCTACAT
CCTGCCCTACAACGACCTGACCAAGTACAGCCAGAAGTTCCAG
GGCAGGGTGACAATCACCAGGGACAAGAGCGCCAGCACCGCC
TACATGGAGCTGAGCAGCCTGAGATCCGAGGACACCGCCGTGT
ACTACTGCACCAGGTGGGACTGGGACGGCTTCTTTGACCCCTG
GGGCCAGGGAACCACAGTGACCGTGTCCTCCAGTGCTGCTGCC
TTTGTCCCGGTATTTCTCCCAGCCAAACCGACCACGACTCCCGC
CCCGCGCCCTCCGACACCCGCTCCCACCATCGCCTCTCAACCTC
TTAGTCTTCGCCCCGAGGCATGCCGACCCGCCGCCGGGGGTGC
TGTTCATACGAGGGGCTTGGACTTCGCTTGTGATATTTACATTT
GGGCTCCGTTGGCGGGTACGTGCGGCGTCCTTTTGTTGTCACTC
GTTATTACTTTGTATTGTAATCACAGGAATCGCTCAAAGCGGA
GTAGGTTGTTGCATTCCGATTACATGAATATGACTCCTCGCCGG
CCTGGGCCGACAAGAAAACATTACCAACCCTATGCCCCCCCAC
GAGACTTCGCTGCGTACAGGTCCCGAGTGAAGTTTTCCCGAAG
CGCAGACGCTCCGGCATATCAGCAAGGACAGAATCAGCTGTAT
AACGAACTGAATTTGGGACGCCGCGAGGAGTATGACGTGCTTG
ATAAACGCCGGGGAGAGACCCGGAAATGGGGGTAAACCCC
GAAGAAAGAATCCCCAAGAAGGACTCTACAATGAACTCCAGA

TABLE 34-continued rAAV Sequences

| SEQ ID NO: | Description | Sequence |
|---|---|---|
| | | AGGATAAGATGGCGGAGGCCTACTCAGAAATAGGTATGAAGG<br>GCGAACGACGACGGGGAAAAGGTCACGATGGCCTCTACCAAG<br>GGTTGAGTACGGCAACCAAAGATACGTACGATGCACTGCATAT<br>GCAGGCCCTGCCTCCCAGATAATAATAAAATCGCTATCCATCG<br>AAGATGGATGTGTGTTGGTTTTTTGTGTGTGGAGCAACAAATCT<br>GACTTTGCATGTGCAAACGCCTTCAACAACAGCATTATTCCAG<br>AAGACACCTTCTTCCCCAGCCCAGGTAAGGGCAGCTTTGGTGC<br>CTTCGCAGGCTGTTTCCTTGCTTCAGGAATGGCCAGGTTCTGCC<br>CAGAGCTCTGGTCAATGATGTCTAAAACTCCTCTGATTGGTGGT<br>CTCGGCCTTATCCATTGCCACCAAAACCCTCTTTTTACTAAGAA<br>ACAGTGAGCCTTGTTCTGGCAGTCCAGAGAATGACACGGGAAA<br>AAAGCAGATGAAGAGAAGGTGGCAGGAGAGGGCACGTGGCCC<br>AGCCTCAGTCTCTCCAACTGAGTTCCTGCCTGCCTGCCTTTGCT<br>CAGACTGTTTGCCCCTTACTGCTCTTCTAGGCCTCATTCTAAGC<br>CCCTTCTCCAAGTTGCCTCTCCTTATTTCTCCCTGTCTGCCAAAA<br>AATCTTTCCCAGCTCACTAAGTCAGTCTCACGCAGTCACTCATT<br>AACCCACCAATCACTGATTGTGCCGGCACATGAATGCACCAGG<br>TGTTGAAGTGGAGGAATTAAAAAGTCAGATGAGGGGTGTGCCC<br>AGAGGAAGCACCATTCTAGTTGGGGGAGCCCATCTGTCAGCTG<br>GGAAAAGTCCAAATAACTTCAGATTGGAATGTGTTTTAACTCA<br>GGGGTTGAGAAAACAGCTACCTTCAGGACAAAAGTCAGGGAAG<br>GGCTCTCTGAAGAAATGCTACTTGAAGATACCAGCCCTACCAA<br>GGGCAGGGAGAGGACCCTATAGAGGCCTGGGACAGGAGCTCA<br>ATGAGAAAGGTAACCACGTGCGGACCGAGGCTGCAGCGTCGTC<br>CTCCCTAGGAACCCCTAGTGATGGAGTTGGCCACTCCCTCTCTG<br>CGCGCTCGCTCGCTCACTGAGGCCGGGCGACCAAAGGTCGCCC<br>GACGCCCGGGCTTTGCCCGGGCGGCCTCAGTGAGCGAGCGAGC<br>GCGCAGCTGCCTGCAGG |
| 1377 | CTX-170 | CCTGCAGGCAGCTGCGCGCTCGCTCGCTCACTGAGGCCGCCCG<br>GGCGTCGGGCGACCTTTGGTCGCCCGGCCTCAGTGAGCGAGCG<br>AGCGCGCAGAGAGGGAGTGGCCAACTCCATCACTAGGGGTTCC<br>TGCGGCCGCACGCGTGAGATGTAAGGAGCTGCTGTGACTTGCT<br>CAAGGCCTTATATCGAGTAAACGGTAGTGCTGGGGCTTAGACG<br>CAGGTGTTCTGATTTATAGTTCAAAACCTCTATCAATGAGAGA<br>GCAATCTCCTGGTAATGTGATAGATTTCCCAACTTAATGCCAAC<br>ATACCATAAACCTCCCATTCTGCTAATGCCCAGCCTAAGTTGGG<br>GAGACCACTCCAGATTCCAAGATGTACAGTTTGCTTTGCTGGG<br>CCTTTTTCCCATGCCTGCCTTTACTCTGCCAGAGTTATATTGCTG<br>GGGTTTTGAAGAAGATCCTATTAAATAAAAGAATAAGCAGTAT<br>TATTAAGTAGCCCTGCATTTCAGGTTTCCTTGAGTGGCAGGCCA<br>GGCCTGGCCGTGAACGTTCACTGAAATCATGGCCTCTTGGCCA<br>AGATTGATAGCTTGTGCCTGTCCCTGAGTCCCAGTCCATCACGA<br>GCAGCTGGTTTCTAAGATGCTATTTCCCGTATAAAGCATGAGA<br>CCGTGACTTGCCAGCCCCACAGAGCCCCGCCCTTGTCCATCACT<br>GGCATCTGGACTCCAGCCTGGGTTGGGGCAAAGAGGGAAATG<br>AGATCATGTCCTAACCCTGATCCTCTTGTCCCACAGATATCCAG<br>AACCCTGACCCTGCCGTGTACCAGCTGAGAGACTCTAAATCCA<br>GTGACAAGTCTGTCTGCCTATTCACCGATTTTGATTCTCAAACA<br>AATGTGTCACAAAGTAAGGATTCTGATGTGTATATCACAGACA<br>AAACTGTGCTAGACATGAGGTCTATGGACTTCAGGCTCCGGTG<br>CCCGTCAGTGGGCAGAGCGCACATCGCCCACAGTCCCCGAGAA<br>GTTGGGGGGAGGGGTCGGCAATTGAACCGGTGCCTAGAGAAG<br>GTGGCGCGGGGTAAACTGGGAAAGTGATGTCGTGTACTGGCTC<br>CGCCTTTTTCCCGAGGGTGGGGGAGAACCGTATATAAGTGCAG<br>TAGTCGCCGTGAACGTTCTTTTTCGCAACGGGTTTGCCGCCAGA<br>ACACAGGTAAGTGCCGTGTGTGGTTCCCGCGGGCCTGGCCTCT<br>TTACGGGTTATGGCCCTTGCGTGCCTTGAATTACTTCCACTGGC<br>TGCAGTACGTGATTCTTGATCCCGAGCTTCGGGTTGGAAGTGG<br>GTGGGAGAGTTCGAGGCCTTGCGCTTAAGGAGCCCCTTCGCCT<br>CGTGCTTGAGTTGAGGCCTGGCCTGGGCGCTGGGGCCGCCGCG<br>TGCGAATCTGGTGGCACCTTCGCGCCTGTCTCGCTGCTTTCGAT<br>AAGTCTCTAGCCATTTAAAATTTTTGATGACCTGCTGCGACGCT<br>TTTTTTCTGGCAAGATAGTCTTGTAAATGCGGGCCAAGATCTGC<br>ACACTGGTATTTCGGTTTTTGGGCCGCGGGCGGCGACGGGGC<br>CCGTGCGTCCCAGCGCACATGTTCGGCGAGGCGGGGCCTGCGA<br>GCGCGGCCACCGAGAATCGGACGGGGGTAGTCTCAAGCTGGCC<br>GGCCTGCTCTGGTGCCTGGCCTCGCGCCGCCGTGTATCGCCCCG<br>CCCTGGGCGGCAAGGCTGGCCCGGTCGGCACCAGTTGCGTGAG<br>CGGAAAGATGGCCGCTTCCCGGCCCTGCTGCAGGGAGCTCAAA<br>ATGGAGGACGCGCGCTCGGGAGAGCGGGCGGGTGAGTCACC<br>CACACAAAGGAAAAGGGCCTTTCCGTCCTCAGCCGTCGCTTCA<br>TGTGACTCCACGGAGTACCGGGCGCCGTCCAGGCACCTCGATT<br>AGTTCTCGAGCTTTTGGAGTACGTCGTCTTTAGGTTGGGGGGAG<br>GGGTTTTATGCGATGGAGTTTCCCCACACTGAGTGGGTGGAGA<br>CTGAAGTTAGGCCAGCTTGGCACTTGATGTAATTCTCCTTGGAA |

TABLE 34-continued rAAV Sequences

| SEQ ID NO: | Description | Sequence |
|---|---|---|
| | | TTTGCCCTTTTTGAGTTTGGATCTTGGTTCATTCTCAAGCCTCAG
ACAGTGGTTCAAAGTTTTTTCTTCCATTTCAGGTGTCGTGACC
ACCATGGCGCTTCCGGTGACAGCACTGCTCCTCCCCTTGGCGCT
GTTGCTCCACGCAGCAAGGCCGGAGGTGCAGCTGCAGCAGAGC
GGCCCTGAGCTGGTGAAGCCCGGCGCCAGCGTGAAGATCAGCT
GCAAGACCTCCGGCTATACCTTTACCGAGTACACCATCAACTG
GGTGAAGCAGAGCCACGGCAAGAGCCTGGAGTGGATCGGCGA
TATCTACCCCGACAACTACAACATCAGGTACAACCAGAAGTTC
AAGGGCAAGGCCACCCTGACCGTGGACAAGTCCAGCAGCACC
GCCTACATGGAGCTGAGGAGCCTGTCCAGCGAGGACTCCGCCA
TCTACTACTGCGCCAACCACGACTTTTTCGTCTTCTGGGGACAG
GGCACCCTGGTGACAGTGTCCGCTGGCGGCGGCGGCAGCGGCG
GCGGCGGCTCCGGAGGCGGCGGCAGCGACATCCAGATGACAC
AGGCCACAAGCTCCCTGTCCGCCAGCCTGGGCGATAGGGTGAC
CATCAATTGCAGGACCTCCCAGGACATCAGCAACCACCTGAAC
TGGTACCAGCAGAAACCCGACGGCACCGTGAAGCTGCTCATCT
ACTACACCAGCAGGCTGCAGTCCGGCGTCCCTAGCAGATTCAG
CGGATCCGGCAGCGGCACCGACTATAGCCTGACCATCAGCAAC
CTCGAGCAGGAGGACATCGGCACCTACTTCTGCCATCAGGGCA
ACACCCTGCCCCCTACCTTTGGCGGCGGCACAAAGCTGGAGAT
TAAGAGTGCTGCTGCCTTTGTCCCGGTATTTCTCCCAGCCAAAC
CGACCACGACTCCCGCCCCGCGCCCTCCGACACCCGCTCCCAC
CATCGCCTCTCAACCTCTTAGTCTTCGCCCCGAGGCATGCCGAC
CCGCCGCCGGGGGTGCTGTTCATACGAGGGGCTTGGACTTCGC
TTGTGATATTTACATTTGGGCTCCGTTGGCGGGTACGTGCGGCG
TCCTTTTGTTGTCACTCGTTATTACTTTGTATTGTAATCACAGGA
ATCGCTCAAAGCGGAGTAGGTTGTTGCATTCCGATTACATGAA
TATGACTCCTCGCCGGCCTGGGCCGACAAGAAAACATTACCAA
CCCTATGCCCCCCCACGAGACTTCGCTGCGTACAGGTCCCGAG
TGAAGTTTTCCCGAAGCGCAGACGCTCCGGCATATCAGCAAGG
ACAGAATCAGCTGTATAACGAACTGAATTTGGGACGCCGCGAG
GAGTATGACGTGCTTGATAAACGCCGGGGAGAGACCCGGAA
ATGGGGGGTAAACCCCGAAGAAAGAATCCCCAAGAAGGACTC
TACAATGAACTCCAGAAGGATAAGATGGCGGAGGCCTACTCAG
AAATAGGTATGAAGGGCGAACGACGACGGGGAAAAGGTCACG
ATGGCCTCTACCAAGGGTTGAGTACGGCAACCAAAGATACGTA
CGATGCACTGCATATGCAGGCCCTGCCTCCCAGATAATAATAA
AATCGCTATCCATCGAAGATGGATGTGTGTTGGTTTTTGTGTG
TGGAGCAACAAATCTGACTTTGCATGTGCAAACGCCTTCAACA
ACAGCATTATTCCAGAAGACACCTTCTTCCCCAGCCCAGGTAA
GGGCAGCTTTGGTGCCTTCGCAGGCTGTTTCCTTGCTTCAGGAA
TGGCCAGGTTCTGCCCAGAGCTCTGGTCAATGATGTCTAAAAC
TCCTCTGATTGGTGGTCTCGGCCTTATCCATTGCCACCAAAACC
CTCTTTTTACTAAGAAACAGTGAGCCTTGTTCTGGCAGTCCAGA
GAATGACACGGGAAAAAAGCAGATGAAGAGAAGGTGGCAGGA
GAGGGCACGTGGCCCAGCCTCAGTCTCTCCAACTGAGTTCCTG
CCTGCCTGCCTTTGCTCAGACTGTTTGCCCCTTACTGCTCTTCTA
GGCCTCATTCTAAGCCCCTTCTCCAAGTTGCCTCTCCTTATTTCT
CCCTGTCTGCCAAAAAATCTTTCCCAGCTCACTAAGTCAGTCTC
ACGCAGTCACTCATTAACCCACCAATCACTGATTGTGCCGGCA
CATGAATGCACCAGGTGTTGAAGTGGAGGAATTAAAAAGTCAG
ATGAGGGGTGTGCCCAGAGGAAGCACCATTCTAGTTGGGGGAG
CCCATCTGTCAGCTGGGAAAAGTCCAAATAACTTCAGATTGGA
ATGTGTTTTAACTCAGGGTTGAGAAAACAGCTACCTTCAGGAC
AAAAGTCAGGGAAGGGCTCTCTGAAGAAATGCTACTTGAAGAT
ACCAGCCCTACCAAGGGCAGGGAGAGGACCCTATAGAGGCCT
GGGACAGGAGCTCAATGAGAAAGGTAACCACGTGCGGACCGA
GGCTGCAGCGTCGTCCTCCCTAGGAACCCCTAGTGATGGAGTT
GGCCACTCCCTCTCTGCGCGCTCGCTCGCTCACTGAGGCCGGGC
GACCAAAGGTCGCCCGACGCCCGGGCTTTGCCCGGGCGGCCTC
AGTGAGCGAGCGAGCGCGCAGCTGCCTGCAGG |
| 1378 | CTX-171 | CCTGCAGGCAGCTGCGCGCTCGCTCGCTCACTGAGGCCGCCCG
GGCGTCGGGCGACCTTTGGTCGCCCGGCCTCAGTGAGCGAGCG
AGCGCGCAGAGAGGGAGTGGCCAACTCCATCACTAGGGGTTCC
TGCGGCCGCACGCGTGAGATGTAAGGAGCTGCTGTGACTTGCT
CAAGGCCTTATATCGAGTAAACGGTAGTGCTGGGGCTTAGACG
CAGGTGTTCTGATTTATAGTTCAAAACCTCTATCAATGAGAGA
GCAATCTCCTGGTAATGTGATAGATTTCCCAACTTAATGCCAAC
ATACCATAAACCTCCCATTCTGCTAATGCCCAGCCTAAGTTGGG
GAGACCACTCCAGATTCCAAGATGTACAGTTTGCTTTGCTGGG
CCTTTTTCCCATGCCTGCCTTTACTCTGCCAGAGTTATATTGCTG
GGGTTTTGAAGAAGATCCTATTAAATAAAAGAATAAGCAGTAT
TATTAAGTAGCCCTGCATTTCAGGTTTCCTTGAGTGGCAGGCCA
GGCCTGGCCGTGAACGTTCACTGAAATCATGGCCTCTTGGCCA
AGATTGATAGCTTGTGCCTGTCCCTGAGTCCCAGTCCATCACGA |

TABLE 34-continued rAAV Sequences

SEQ ID NO:Description Sequence

GCAGCTGGTTTCTAAGATGCTATTTCCCGTATAAAGCATGAGA
CCGTGACTTGCCAGCCCCACAGAGCCCCGCCCTTGTCCATCACT
GGCATCTGGACTCCAGCCTGGGTTGGGGCAAAGAGGGAAATG
AGATCATGTCCTAACCCTGATCCTCTTGTCCCACAGATATCCAG
AACCCTGACCCTGCCGTGTACCAGCTGAGAGACTCTAAATCCA
GTGACAAGTCTGTCTGCCTATTCACCGATTTTGATTCTCAAACA
AATGTGTCACAAAGTAAGGATTCTGATGTGTATATCACAGACA
AAACTGTGCTAGACATGAGGTCTATGGACTTCAGGCTCCGGTG
CCCGTCAGTGGGCAGAGCGCACATCGCCCACAGTCCCCGAGAA
GTTGGGGGGAGGGGTCGGCAATTGAACCGGTGCCTAGAGAAG
GTGGCGCGGGGTAAACTGGGAAAGTGATGTCGTGTACTGGCTC
CGCCTTTTTCCCGAGGGTGGGGGAGAACCGTATATAAGTGCAG
TAGTCGCCGTGAACGTTCTTTTTCGCAACGGGTTTGCCGCCAGA
ACACAGGTAAGTGCCGTGTGTGGTTCCCGCGGGCCTGGCCTCT
TTACGGGTTATGGCCCTTGCGTGCCTTGAATTACTTCCACTGGC
TGCAGTACGTGATTCTTGATCCCGAGCTTCGGGTTGGAAGTGG
GTGGGAGAGTTCGAGGCCTTGCGCTTAAGGAGCCCCTTCGCCT
CGTGCTTGAGTTGAGGCCTGGCCTGGGCGCTGGGGCCGCCGCG
TGCGAATCTGGTGGCACCTTCGCGCCTGTCTCGCTGCTTTCGAT
AAGTCTCTAGCCATTTAAAATTTTTGATGACCTGCTGCGACGCT
TTTTTTCTGGCAAGATAGTCTTGTAAATGCGGGCCAAGATCTGC
ACACTGGTATTTCGGTTTTTGGGGCCGCGGGCGGCGACGGGGC
CCGTGCGTCCCAGCGCACATGTTCGGCGAGGCGGGGCCTGCGA
GCGCGGCCACCGAGAATCGGACGGGGGTAGTCTCAAGCTGGCC
GGCCTGCTCTGGTGCCTGGCCTCGCGCCGCCGTGTATCGCCCG
CCCTGGGCGGCAAGGCTGGCCCGGTCGGCACCAGTTGCGTGAG
CGGAAAGATGGCCGCTTCCCGGCCCTGCTGCAGGGAGCTCAAA
ATGGAGGACGCGGCGCTCGGGAGAGCGGGCGGGTGAGTCACC
CACACAAAGGAAAAGGGCCTTTCCGTCCTCAGCCGTCGCTTCA
TGTGACTCCACGGAGTACCGGGCGCCGTCCAGGCACCTCGATT
AGTTCTCGAGCTTTTGGAGTACGTCGTCTTTAGGTTGGGGGGAG
GGGTTTTATGCGATGGAGTTTCCCCACACTGAGTGGGTGGAGA
CTGAAGTTAGGCCAGCTTGGCACTTGATGTAATTCTCCTTGGAA
TTTGCCCTTTTTGAGTTTGGATCTTGGTTCATTCTCAAGCCTCAG
ACAGTGGTTCAAAGTTTTTTTCTTCCATTTCAGGTGTCGTGACC
ACCATGGCGCTTCCGGTGACAGCACTGCTCCTCCCCTTGGCGCT
GTTGCTCCACGCAGCAAGGCCGGATATCCAGATGACCCAGGCC
ACCAGCAGCCTGAGCGCTTCCCTCGGCGACAGGGTGACCATCA
ACTGCAGGACCAGCCAGGACATCTCCAACCACCTGAACTGGTA
CCAGCAGAAGCCCGACGGCACCGTGAAACTGCTGATCTACTAC
ACCAGCAGACTGCAGAGCGGCGTGCCCTCCAGATTTTCCGGCA
GCGGCTCCGGCACCGACTACAGCCTGACCATTAGCAACCTGGA
GCAGGAGGACATCGGAACCTACTTCTGCCACCAGGGCAACACA
CTGCCTCCCACCTTCGGCGGCGGCACAAAGCTCGAGATCAAGG
GCGGCGGCGGAAGCGGCGGCGGCGGCAGCGGCGGCGGAGGCT
CCGAGGTGCAACTGCAACAGAGCGGACCTGAGCTGGTGAAGC
CTGGCGCCAGCGTGAAGATCTCCTGTAAGACCAGCGGCTACAC
CTTCACCGAGTACACCATCAACTGGGTGAAGCAGAGCCACGGC
AAGAGCCTCGAATGGATCGGCGACATCTATCCCGACAACTACA
ATATCAGATACAACCAGAAGTTCAAGGGAAAGGCCACCCTGAC
CGTGGATAAGTCCTCCTCCACCGCTTACATGGAGCTGAGGAGC
CTGAGCAGCGAGGACTCCGCCATCTACTACTGCGCCAACCACG
ACTTCTTCGTGTTCTGGGGCCAAGGCACCCTCGTGACCGTGAGC
GCCAGTGCTGCTGCCTTTGTCCCGGTATTTCTCCCAGCCAAACC
GACCACGACTCCCGCCCCGCGCCCTCCGACACCCGCTCCCACC
ATCGCCTCTCAACCTCTTAGTCTTCGCCCCGAGGCATGCCGACC
CGCCGCCGGGGGTGCTGTTCATACGAGGGGCTTGGACTTCGCT
TGTGATATTTACATTTGGGCTCCGTTGGCGGGTACGTGCGGCGT
CCTTTTGTTGTCACTCGTTATTACTTTGTATTGTAATCACAGGAA
TCGCTCAAAGCGGAGTAGGTTGTTGCATTCCGATTACATGAAT
ATGACTCCTCGCCGGCCTGGGCCGACAAGAAAACATTACCAAC
CCTATGCCCCCCACGAGACTTCGCTGCGTACAGGTCCCGAGT
GAAGTTTTCCCGAAGCGCAGACGCTCCGGCATATCAGCAAGGA
CAGAATCAGCTGTATAACGAACTGAATTTGGGACGCCGCGAGG
AGTATGACGTGCTTGATAAACGCCGGGGAGAGACCCGGAAA
TGGGGGGTAAACCCCGAAGAAAGAATCCCCAAGAAGGACTCT
ACAATGAACTCCAGAAGGATAAGATGGCGGAGGCCTACTCAG
AAATAGGTATGAAGGGCGAACGACGACGGGGAAAAGGTCACG
ATGGCCTCTACCAAGGGTTGAGTACGGCAACCAAAGATACGTA
CGATGCACTGCATATGCAGGCCCTGCCTCCCAGATAATAATAA
AATCGCTATCCATCGAAGATGGATGTGTGTTGGTTTTTTGTGTG
TGGAGCAACAAATCTGACTTTGCATGTGCAAACGCCTTCAACA
ACAGCATTATTCCAGAAGACACCTTCTTCCCCAGCCCAGGTAA
GGGCAGCTTTGGTGCCTTCGCAGGCTGTTTCCTTGCTTCAGGAA
TGGCCAGGTTCTGCCCAGAGCTCTGGTCAATGATGTCTAAAAC
TCCTCTGATTGGTGGTCTCGGCCTTATCCATTGCCACCAAAACC

TABLE 34-continued rAAV Sequences

| SEQ ID NO: | Description | Sequence |
|---|---|---|
| | | CTCTTTTTACTAAGAAACAGTGAGCCTTGTTCTGGCAGTCCAGA<br>GAATGACACGGGAAAAAAGCAGATGAAGAGAAGGTGGCAGGA<br>GAGGGCACGTGGCCCAGCCTCAGTCTCTCCAACTGAGTTCCTG<br>CCTGCCTGCCTTTGCTCAGACTGTTTGCCCCTTACTGCTCTTCTA<br>GGCCTCATTCTAAGCCCCTTCTCCAAGTTGCCTCTCCTTATTTCT<br>CCCTGTCTGCCAAAAAATCTTTCCCAGCTCACTAAGTCAGTCTC<br>ACGCAGTCACTCATTAACCCACCAATCACTGATTGTGCCGGCA<br>CATGAATGCACCAGGTGTTGAAGTGGAGGAATTAAAAAGTCAG<br>ATGAGGGGTGTGCCCAGAGGAAGCACCATTCTAGTTGGGGGAG<br>CCCATCTGTCAGCTGGGAAAAGTCCAAATAACTTCAGATTGGA<br>ATGTGTTTTAACTCAGGGTTGAGAAAACAGCTACCTTCAGGAC<br>AAAAGTCAGGGAAGGGCTCTCTGAAGAAATGCTACTTGAAGAT<br>ACCAGCCCTACCAAGGGCAGGGAGAGGACCCTATAGAGGCCT<br>GGGACAGGAGCTCAATGAGAAAGGTAACCACGTGCGGACCGA<br>GGCTGCAGCGTCGTCCTCCCTAGGAACCCCTAGTGATGGAGTT<br>GGCCACTCCCTCTCTGCGCGCTCGCTCGCTCACTGAGGCCGGGC<br>GACCAAAGGTCGCCCGACGCCCGGGCTTTGCCCGGGCGGCCTC<br>AGTGAGCGAGCGAGCGCGCAGCTGCCTGCAGG |
| 1379 | CTX-172 | CCTGCAGGCAGCTGCGCGCTCGCTCGCTCACTGAGGCCGCCCG<br>GGCGTCGGGCGACCTTTGGTCGCCCGGCCTCAGTGAGCGAGCG<br>AGCGCGCAGAGAGGGAGTGGCCAACTCCATCACTAGGGGTTCC<br>TGCGGCCGCACGCGTGAGATGTAAGGAGCTGCTGTGACTTGCT<br>CAAGGCCTTATATCGAGTAAACGGTAGTGCTGGGGCTTAGACG<br>CAGGTGTTCTGATTTATAGTTCAAAACCTCTATCAATGAGAGA<br>GCAATCTCCTGGTAATGTGATAGATTTCCCAACTTAATGCCAAC<br>ATACCATAAACCTCCCATTCTGCTAATGCCCAGCCTAAGTTGGG<br>GAGACCACTCCAGATTCCAAGATGTACAGTTTGCTTTGCTGGG<br>CCTTTTTCCCATGCCTGCCTTTACTCTGCCAGAGTTATATTGCTG<br>GGGTTTTGAAGAAGATCCTATTAAATAAAAGAATAAGCAGTAT<br>TATTAAGTAGCCCTGCATTTCAGGTTTCCTTGAGTGGCAGGCCA<br>GGCCTGGCCGTGAACGTTCACTGAAATCATGGCCTCTTGGCCA<br>AGATTGATAGCTTGTGCCTGTCCCTGAGTCCCAGTCCATCACGA<br>GCAGCTGGTTTCTAAGATGCTATTTCCCGTATAAAGCATGAGA<br>CCGTGACTTGCCAGCCCCACAGAGCCCCGCCCTTGTCCATCACT<br>GGCATCTGGACTCCAGCCTGGGTTGGGGCAAAGAGGGAAATG<br>AGATCATGTCCTAACCCTGATCCTCTTGTCCCACAGATATCCAG<br>AACCCTGACCCTGCCGTGTACCAGCTGAGAGACTCTAAATCCA<br>GTGACAAGTCTGTCTGCCTATTCACCGATTTTGATTCTCAAACA<br>AATGTGTCACAAAGTAAGGATTCTGATGTGTATATCACAGACA<br>AAACTGTGCTAGACATGAGGTCTATGGACTTCAGGCTCCGGTG<br>CCCGTCAGTGGGCAGAGCGCACATCGCCCACAGTCCCCGAGAA<br>GTTGGGGGGAGGGGTCGGCAATTGAACCGGTGCCTAGAGAAG<br>GTGGCGCGGGGTAAACTGGGAAAGTGATGTCGTGTACTGGCTC<br>CGCCTTTTTCCCGAGGGTGGGGGAGAACCGTATATAAGTGCAG<br>TAGTCGCCGTGAACGTTCTTTTTCGCAACGGGTTTGCCGCCAGA<br>ACACAGGTAAGTGCCGTGTGTGGTTCCCGCGGGCCTGGCCTCT<br>TTACGGGTTATGGCCCTTGCGTGCCTTGAATTACTTCCACTGGC<br>TGCAGTACGTGATTCTTGATCCCGAGCTTCGGGTTGGAAGTGG<br>GTGGGAGAGTTCGAGGCCTTGCGCTTAAGGAGCCCCTTCGCCT<br>CGTGCTTGAGTTGAGGCCTGGCCTGGGCGCTGGGGCCGCCGCG<br>TGCGAATCTGGTGGCACCTTCGCGCCTGTCTCGCTGCTTTCGAT<br>AAGTCTCTAGCCATTTAAAATTTTTGATGACCTGCTGCGACGCT<br>TTTTTTCTGGCAAGATAGTCTTGTAAATGCGGGCCAAGATCTGC<br>ACACTGGTATTTCGGTTTTTGGGGCCGCGGGCGGCGACGGGGC<br>CCGTGCGTCCCAGCGCACATGTTCGGCGAGGCGGGGCCTGCGA<br>GCGCGGCCACCGAGAATCGGACGGGGGTAGTCTCAAGCTGGCC<br>GGCCTGCTCTGGTGCCTGGCCTCGCGCCGCCGTGTATCGCCCCG<br>CCCTGGGCGGCAAGGCTGGCCCGGTCGGCACCAGTTGCGTGAG<br>CGGAAAGATGGCCGCTTCCCGGCCCTGCTGCAGGGAGCTCAAA<br>ATGGAGGACGCGGCGCTCGGGAGAGCGGGCGGGTGAGTCACC<br>CACACAAAGGAAAAGGGCCTTTCCGTCCTCAGCCGTCGCTTCA<br>TGTGACTCCACGGAGTACCGGGCGCCGTCCAGGCACCTCGATT<br>AGTTCTCGAGCTTTTGGAGTACGTCGTCTTTAGGTTGGGGGGAG<br>GGGTTTTATGCGATGGAGTTTCCCCACACTGAGTGGGTGGAGA<br>CTGAAGTTAGGCCAGCTTGGCACTTGATGTAATTCTCCTTGGAA<br>TTTGCCCTTTTTGAGTTTGGATCTTGGTTCATTCTCAAGCCTCAG<br>ACAGTGGTTCAAAGTTTTTTTCTTCCATTTCAGGTGTCGTGACC<br>ACCATGGCGCTTCCGGTGACAGCACTGCTCCTCCCCTTGGCGCT<br>GTTGCTCCACGCAGCAAGGCCGCAGGTGCAGCTGGTGCAGTCC<br>GGCGCTGAGCTGAAGAAGCCCGGCGCCAGCGTGAAGATCAGC<br>TGCAAGGCCAGCGGCTACACCTTCACCGAATACACCATCAACT<br>GGGTGAGACAGGCCCCTGGACAGAGGCTCGAGTGGATGGGCG<br>ACATCTACCCCGACAACTACAGCATCAGGTACAACCAGAAGTT<br>CCAGGGCAGGGTGACAATCACCAGGGACACCAGCGCCAGCAC<br>CGCCTATATGGAGCTGAGCAGCCTGAGATCCGAGGACACCGCC |

TABLE 34-continued rAAV Sequences

| SEQ ID NO: | Description | Sequence |
|---|---|---|
| | | GTCTATTACTGCGCCAACCACGACTTCTTCGTGTTCTGGGGCCA
GGGAACACTGGTGACCGTGTCCAGCGGCGGCGGCGGCAGCGG
CGGCGGAGGAAGCGGCGGCGGCGGCAGCGATATCCAGATGAC
CCAGAGCCCCTCCTCCCTGAGCGCTAGCGTGGGCGACAGGGTG
ACCATTACCTGTCAGGCCTCCCAGGACATCAGCAACTACCTGA
ACTGGTACCAGCAGAAGCCTGGCAAGGCCCCCAAGCTGCTGAT
CTATTACACCAGCAGGCTGGAGACCGGCGTGCCCTCCAGATTC
AGCGGCTCCGGCTCCGGAACCGACTTCACCTTCACCATCAGCT
CCCTGCAGCCTGAGGACATCGCCACCTACTACTGCCAGCAGGG
CAACACCCTGCCTCCCACATTCGGCGGCGGCACAAAGGTGGAG
ATCAAAGTGCTGCTGCCTTTGTCCCGGTATTTCTCCCAGCCAA
ACCGACCACGACTCCCGCCCCGCGCCCTCCGACACCCGCTCCC
ACCATCGCCTCTCAACCTCTTAGTCTTCGCCCCGAGGCATGCCG
ACCCGCCGCCGGGGGTGCTGTTCATACGAGGGGCTTGGACTTC
GCTTGTGATATTTACATTTGGGCTCCGTTGGCGGGTACGTGCGG
CGTCCTTTTGTTGTCACTCGTTATTACTTTGTATTGTAATCACAG
GAATCGCTCAAAGCGGAGTAGGTTGTTGCATTCCGATTACATG
AATATGACTCCTCGCCGGCCTGGGCCGACAAGAAAACATTACC
AACCCTATGCCCCCCCACGAGACTTCGCTGCGTACAGGTCCCG
AGTGAAGTTTTCCCGAAGCGCAGACGCTCCGGCATATCAGCAA
GGACAGAATCAGCTGTATAACGAACTGAATTTGGGACGCCGCG
AGGAGTATGACGTGCTTGATAAACGCCGGGGAGAGACCCGG
AAATGGGGGGTAAACCCCGAAGAAAGAATCCCCAAGAAGGAC
TCTACAATGAACTCCAGAAGGATAAGATGGCGGAGGCCTACTC
AGAAATAGGTATGAAGGGCGAACGACGACGGGGAAAAGGTCA
CGATGGCCTCTACCAAGGGTTGAGTACGGCAACCAAAGATACG
TACGATGCACTGCATATGCAGGCCCTGCCTCCCAGATAATAAT
AAAATCGCTATCCATCGAAGATGGATGTGTGTTGGTTTTTGTG
TGTGGAGCAACAAATCTGACTTTGCATGTGCAAACGCCTTCAA
CAACAGCATTATTCCAGAAGACACCTTCTTCCCCAGCCCAGGT
AAGGGCAGCTTTGGTGCCTTCGCAGGCTGTTTCCTTGCTTCAGG
AATGGCCAGGTTCTGCCCAGAGCTCTGGTCAATGATGTCTAAA
ACTCCTCTGATTGGTGGTCTCGGCCTTATCCATTGCCACCAAAA
CCCTCTTTTTACTAAGAAACAGTGAGCCTTGTTCTGGCAGTCCA
GAGAATGACACGGGAAAAAAGCAGATGAAGAGAAGGTGGCAG
GAGAGGGCACGTGGCCCAGCCTCAGTCTCTCCAACTGAGTTCC
TGCCTGCCTGCCTTTGCTCAGACTGTTTGCCCCTTACTGCTCTTC
TAGGCCTCATTCTAAGCCCCTTCTCCAAGTTGCCTCTCCTTATTT
CTCCCTGTCTGCCAAAAAATCTTTCCCAGCTCACTAAGTCAGTC
TCACGCAGTCACTCATTAACCCACCAATACTGATTGTGCCGGC
ACATGAATGCACCAGGTGTTGAAGTGGAGGAATTAAAAAGTCA
GATGAGGGGTGTGCCCAGAGGAAGCACCATTCTAGTTGGGGGA
GCCCATCTGTCAGCTGGGAAAAGTCCAAATAACTTCAGATTGG
AATGTGTTTTAACTCAGGGTTGAGAAAACAGCTACCTTCAGGA
CAAAAGTCAGGGAAGGGCTCTCTGAAGAAATGCTACTTGAAGA
TACCAGCCCTACCAAGGGCAGGGAGAGGACCCTATAGAGGCCT
GGGACAGGAGCTCAATGAGAAAGGTAACCACGTGCGGACCGA
GGCTGCAGCGTCGTCCTCCCTAGGAACCCCTAGTGATGGAGTT
GGCCACTCCCTCTCTGCGCGCTCGCTCGCTCACTGAGGCCGGGC
GACCAAAGGTCGCCCGACGCCCGGGCTTTGCCCGGGCGGCCTC
AGTGAGCGAGCGAGCGCGCAGCTGCCTGCAGG |
| 1380 | CTX-173 | CCTGCAGGCAGCTGCGCGCTCGCTCGCTCACTGAGGCCGCCCG
GGCGTCGGGCGACCTTTGGTCGCCCGGCCTCAGTGAGCGAGCG
AGCGCGCAGAGAGGGAGTGGCCAACTCCATCACTAGGGGTTCC
TGCGGCCGCACGCGTGAGATGTAAGGAGCTGCTGTGACTTGCT
CAAGGCCTTATATCGAGTAAACGGTAGTGCTGGGGCTTAGACG
CAGGTGTTCTGATTTATAGTTCAAAACCTCTATCAATGAGAGA
GCAATCTCCTGGTAATGTGATAGATTTCCCAACTTAATGCCAAC
ATACCATAAACCTCCCATTCTGCTAATGCCCAGCCTAAGTTGGG
GAGACCACTCCAGATTCCAAGATGTACAGTTTGCTTTGCTGGG
CCTTTTTCCCATGCCTGCCTTTACTCTGCCAGAGTTATATTGCTG
GGGTTTTGAAGAAGATCCTATTAAATAAAAGAATAAGCAGTAT
TATTAAGTAGCCCTGCATTTCAGGTTTCCTTGAGTGGCAGGCCA
GGCCTGGCCGTGAACGTTCACTGAAATCATGGCCTCTTGGCCA
AGATTGATAGCTTGTGCCTGTCCCTGAGTCCCAGTCCATCACGA
GCAGCTGGTTTCTAAGATGCTATTTCCCGTATAAAGCATGAGA
CCGTGACTTGCCAGCCCCACAGAGCCCCGCCCTTGTCCATCACT
GGCATCTGGACTCCAGCCTGGGTTGGGCAAAGAGGGAAATG
AGATCATGTCCTAACCCTGATCCTCTTGTCCCACAGATATCCAG
AACCCTGACCCTGCCGTGTACCAGCTGAGAGACTCTAAATCCA
GTGACAAGTCTGTCTGCCTATTCACCGATTTTGATTCTCAAACA
AATGTGTCACAAAGTAAGGATTCTGATGTGTATATCACAGACA
AAACTGTGCTAGACATGAGGTCTATGGACTTCAGGCTCCGGTG
CCCGTCAGTGGGCAGAGCGCACATCGCCCACAGTCCCCGAGAA
GTTGGGGGGAGGGGTCGGCAATTGAACCGGTGCCTAGAGAAG |

TABLE 34-continued rAAV Sequences

SEQ ID NO:Description Sequence

GTGGCGCGGGGTAAACTGGGAAAGTGATGTCGTGTACTGGCTC
CGCCTTTTTCCCGAGGGTGGGGGAGAACCGTATATAAGTGCAG
TAGTCGCCGTGAACGTTCTTTTTCGCAACGGGTTTGCCGCCAGA
ACACAGGTAAGTGCCGTGTGTGGTTCCCGCGGGCCTGGCCTCT
TTACGGGTTATGGCCCTTGCGTGCCTTGAATTACTTCCACTGGC
TGCAGTACGTGATTCTTGATCCCGAGCTTCGGGTTGGAAGTGG
GTGGGAGAGTTCGAGGCCTTGCGCTTAAGGAGCCCCTTCGCCT
CGTGCTTGAGTTGAGGCCTGGCCTGGGCGCTGGGGCCGCCGCG
TGCGAATCTGGTGGCACCTTCGCGCCTGTCTCGCTGCTTTCGAT
AAGTCTCTAGCCATTTAAAATTTTTGATGACCTGCTGCGACGCT
TTTTTTCTGGCAAGATAGTCTTGTAAATGCGGGCCAAGATCTGC
ACACTGGTATTTCGGTTTTTGGGGCCGCGGGCGGCGACGGGGC
CCGTGCGTCCCAGCGCACATGTTCGGCGAGGCGGGGCCTGCGA
GCGCGGCCACCGAGAATCGGACGGGGGTAGTCTCAAGCTGGCC
GGCCTGCTCTGGTGCCTGGCCTCGCGCCGCCGTGTATCGCCCCG
CCCTGGGCGGCAAGGCTGGCCCGGTCGGCACCAGTTGCGTGAG
CGGAAAGATGGCCGCTTCCCGGCCCTGCTGCAGGGAGCTCAAA
ATGGAGGACGCGGCGCTCGGGAGAGCGGGCGGGTGAGTCACC
CACACAAAGGAAAAGGGCCTTTCCGTCCTCAGCCGTCGCTTCA
TGTGACTCCACGGAGTACCGGGCGCCGTCCAGGCACCTCGATT
AGTTCTCGAGCTTTTGGAGTACGTCGTCTTTAGGTTGGGGGGAG
GGGTTTTATGCGATGGAGTTTCCCCACACTGAGTGGGTGGAGA
CTGAAGTTAGGCCAGCTTGGCACTTGATGTAATTCTCCTTGGAA
TTTGCCCTTTTTGAGTTTGGATCTTGGTTCATTCTCAAGCCTCAG
ACAGTGGTTCAAAGTTTTTTTCTTCCATTTCAGGTGTCGTGACC
ACCATGGCGCTTCCGGTGACAGCACTGCTCCTCCCCTTGGCGCT
GTTGCTCCACGCAGCAAGGCCGCAGGTGCAGCTGGTCCAGTCC
GGCGCCGAACTGAAGAAGCCTGGCGCCAGCGTGAAGATCAGC
TGCAAGGCCTCCGGCTACACCTTCACCGAGTACACCATCAACT
GGGTGAGGCAAGCCCCCGGCCAGAGACTGGAGTGGATGGGCG
ACATCTACCCCGACAACTACAGCATCAGGTACAACCAGAAGTT
CCAGGGCAGGGTGACAATCACCAGGGATACCAGCGCCAGCAC
AGCCTATATGGAGCTGTCCTCCCTGAGATCCGAGGACACCGCC
GTGTATTACTGCGCCAACCACGACTTCTTCGTGTTCTGGGGCCA
AGGCACCCTGGTGACCGTGAGCAGCGGCGGCGGCGGCTCCGGC
GGCGGAGGCTCCGGAGGCGGAGGCAGCGACATCCAGATGACC
CAGAGCCCTTCCAGCCTGAGCGCTAGCCTGGGCGACAGGGTGA
CCATCACCTGCAGGACCAGCCAGGACATCAGCAATCACCTGAA
CTGGTACCAGCAAAAGCCCGGCAAGGCCCCTAAGCTGCTGATC
TACTACACCAGCAGGCTGGAAAGCGGCGTGCCTAGCAGGTTCA
GCGGCAGCGGCTCCGGAACCGACTACAGCCTGACCATTAGCAG
CCTGCAACCTGAGGACATCGGCACCTATTACTGCCAGCAGGGC
AACACCCTGCCTCCTACCTTTGGCGGCGGCACCAAACTCGAGA
TCAAGAGTGCTGCTGCCTTTGTCCCGGTATTTCTCCCAGCCAAA
CCGACCACGACTCCCGCCCCGCGCCCTCCGACACCCGCTCCCA
CCATCGCCTCTCAACCTCTTAGTCTTCGCCCCGAGGCATGCCGA
CCCGCCGCCGGGGTGCTGTTCATACGAGGGGCTTGGACTTCG
CTTGTGATATTTACATTTGGGCTCCGTTGGCGGGTACGTGCGGC
GTCCTTTTGTTGTCACTCGTTATTACTTTGTATTGTAATCACAGG
AATCGCTCAAAGCGGAGTAGGTTGTTGCATTCCGATTACATGA
ATATGACTCCTCGCCGGCCTGGGCCGACAAGAAAACATTACCA
ACCCTATGCCCCCCCACGAGACTTCGCTGCGTACAGGTCCCGA
GTGAAGTTTTCCCGAAGCGCAGACGCTCCGGCATATCAGCAAG
GACAGAATCAGCTGTATAACGAACTGAATTTGGGACGCCGCGA
GGAGTATGACGTGCTTGATAAACGCCGGGGGAGAGACCCGGA
AATGGGGGGTAAACCCCGAAGAAAGAATCCCCAAGAAGGACT
CTACAATGAACTCCAGAAGGATAAGATGGCGGAGGCCTACTCA
GAAATAGGTATGAAGGGCGAACGACGACGGGGAAAAGGTCAC
GATGGCCTCTACCAAGGGTTGAGTACGGCAACCAAAGATACGT
ACGATGCACTGCATATGCAGGCCCTGCCTCCCAGATAATAATA
AAATCGCTATCCATCGAAGATGGATGTGTGTTGGTTTTTTGTGT
GTGGAGCAACAAATCTGACTTTGCATGTGCAAACGCCTTCAAC
AACAGCATTATTCCAGAAGACACCTTCTTCCCCAGCCCAGGTA
AGGGCAGCTTTGGTGCCTTCGCAGGCTGTTTCCTTGCTTCAGGA
ATGGCCAGGTTCTGCCCAGAGCTCTGGTCAATGATGTCTAAAA
CTCCTCTGATTGGTGGTCTCGGCCTTATCCATTGCCACCAAAAC
CCTCTTTTTACTAAGAAACAGTGAGCCTTGTTCTGGCAGTCCAG
AGAATGACACGGGAAAAAAGCAGATGAAGAGAAGGTGGCAGG
AGAGGGCACGTGGCCCAGCCTCAGTCTCTCCAACTGAGTTCCT
GCCTGCCTGCCTTTGCTCAGACTGTTTGCCCCTTACTGCTCTTCT
AGGCCTCATTCTAAGCCCCTTCTCCAAGTTGCCTCTCCTTATTTC
TCCCTGTCTGCCAAAAAATCTTTCCCAGCTCACTAAGTCAGTCT
CACGCAGTCACTCATTAACCCACCAATCACTGATTGTGCCGGC
ACATGAATGCACCAGGTGTTGAAGTGGAGGAATTAAAAAGTCA
GATGAGGGGTGTGCCCAGAGGAAGCACCATTCTAGTTGGGGGA
GCCCATCTGTCAGCTGGGAAAAGTCCAAATAACTTCAGATTGG

TABLE 34-continued rAAV Sequences

| SEQ ID NO: | Description | Sequence |
|---|---|---|
| | | AATGTGTTTTAACTCAGGGTTGAGAAAACAGCTACCTTCAGGA |
| | | CAAAAGTCAGGGAAGGGCTCTCTGAAGAAATGCTACTTGAAGA |
| | | TACCAGCCCTACCAAGGGCAGGGAGAGGACCCTATAGAGGCCT |
| | | GGGACAGGAGCTCAATGAGAAAGGTAACCACGTGCGGACCGA |
| | | GGCTGCAGCGTCGTCCTCCCTAGGAACCCCTAGTGATGGAGTT |
| | | GGCCACTCCCTCTCTGCGCGCTCGCTCGCTCACTGAGGCCGGGC |
| | | GACCAAAGGTCGCCCGACGCCCGGGCTTTGCCCGGGCGGCCTC |
| | | AGTGAGCGAGCGAGCGCGCAGCTGCCTGCAGG |
| 1381 | CTX-174 | CCTGCAGGCAGCTGCGCGCTCGCTCGCTCACTGAGGCCGCCCG |
| | | GGCGTCGGGCGACCTTTGGTCGCCCGGCCTCAGTGAGCGAGCG |
| | | AGCGCGCAGAGAGGGAGTGGCCAACTCCATCACTAGGGGTTCC |
| | | TGCGGCCGCACGCGTGAGATGTAAGGAGCTGCTGTGACTTGCT |
| | | CAAGGCCTTATATCGAGTAAACGGTAGTGCTGGGGCTTAGACG |
| | | CAGGTGTTCTGATTTATAGTTCAAAACCTCTATCAATGAGAGA |
| | | GCAATCTCCTGGTAATGTGATAGATTTCCCAACTTAATGCCAAC |
| | | ATACCATAAACCTCCCATTCTGCTAATGCCCAGCCTAAGTTGGG |
| | | GAGACCACTCCAGATTCCAAGATGTACAGTTTGCTTTGCTGGG |
| | | CCTTTTTCCCATGCCTGCCTTTACTCTGCCAGAGTTATATTGCTG |
| | | GGGTTTTGAAGAAGATCCTATTAAATAAAAGAATAAGCAGTAT |
| | | TATTAAGTAGCCCTGCATTTCAGGTTTCCTTGAGTGGCAGGCCA |
| | | GGCCTGGCCGTGAACGTTCACTGAAATCATGGCCTCTTGGCCA |
| | | AGATTGATAGCTTGTGCCTGTCCCTGAGTCCCAGTCCATCACGA |
| | | GCAGCTGGTTTCTAAGATGCTATTTCCCGTATAAAGCATGAGA |
| | | CCGTGACTTGCCAGCCCCACAGAGCCCCGCCCTTGTCCATCACT |
| | | GGCATCTGGACTCCAGCCTGGGTTGGGGCAAAGAGGGAAATG |
| | | AGATCATGTCCTAACCCTGATCCTCTTGTCCCACAGATATCCAG |
| | | AACCCTGACCCTGCCGTGTACCAGCTGAGAGACTCTAAATCCA |
| | | GTGACAAGTCTGTCTGCCTATTCACCGATTTTGATTCTCAAACA |
| | | AATGTGTCACAAAGTAAGGATTCTGATGTGTATATCACAGACA |
| | | AAACTGTGCTAGACATGAGGTCTATGGACTTCAGGCTCCGGTG |
| | | CCCGTCAGTGGGCAGAGCGCACATCGCCCACAGTCCCCGAGAA |
| | | GTTGGGGGGAGGGGTCGGCAATTGAACCGGTGCCTAGAGAAG |
| | | GTGGCGCGGGGTAAACTGGGAAAGTGATGTCGTGTACTGGCTC |
| | | CGCCTTTTTCCCGAGGGTGGGGGAGAACCGTATATAAGTGCAG |
| | | TAGTCGCCGTGAACGTTCTTTTTCGCAACGGGTTTGCCGCCAGA |
| | | ACACAGGTAAGTGCCGTGTGTGGTTCCCGCGGGCCTGGCCTCT |
| | | TTACGGGTTATGGCCCTTGCGTGCCTTGAATTACTTCCACTGGC |
| | | TGCAGTACGTGATTCTTGATCCCGAGCTTCGGGTTGGAAGTGG |
| | | GTGGGAGAGTTCGAGGCCTTGCGCTTAAGGAGCCCCTTCGCCT |
| | | CGTGCTTGAGTTGAGGCCTGGCCTGGGCGCTGGGGCCGCCGCG |
| | | TGCGAATCTGGTGGCACCTTCGCGCCTGTCTCGCTGCTTTCGAT |
| | | AAGTCTCTAGCCATTTAAAATTTTTGATGACCTGCTGCGACGCT |
| | | TTTTTTCTGGCAAGATAGTCTTGTAAATGCGGGCCAAGATCTGC |
| | | ACACTGGTATTTCGGTTTTTGGGCCGCGGGCGGCGACGGGGC |
| | | CCGTGCGTCCCAGCGCACATGTTCGGCGAGGCGGGGCCTGCGA |
| | | GCGCGGCCACCGAGAATCGGACGGGGGTAGTCTCAAGCTGGCC |
| | | GGCCTGCTCTGGTGCCTGGCCTCGCGCCGCCGTGTATCGCCCCG |
| | | CCCTGGGCGGCAAGGCTGGCCCGGTCGGCACCAGTTGCGTGAG |
| | | CGGAAAGATGGCCGCTTCCCGGCCCTGCTGCAGGGAGCTCAAA |
| | | ATGGAGGACGCGGCGCTCGGGAGAGCGGGCGGGTGAGTCACC |
| | | CACACAAAGGAAAAGGGCCTTTCCGTCCTCAGCCGTCGCTTCA |
| | | TGTGACTCCACGGAGTACCGGGCGCCGTCCAGGCACCTCGATT |
| | | AGTTCTCGAGCTTTTGGAGTACGTCGTCTTTAGGTTGGGGGGAG |
| | | GGGTTTTATGCGATGGAGTTTCCCCACACTGAGTGGGTGGAGA |
| | | CTGAAGTTAGGCCAGCTTGGCACTTGATGTAATTCTCCTTGGAA |
| | | TTTGCCCTTTTTGAGTTTGGATCTTGGTTCATTCTCAAGCCTCAG |
| | | ACAGTGGTTCAAAGTTTTTTTCTTCCATTTCAGGTGTCGTGACC |
| | | ACCATGGCGCTTCCGGTGACAGCACTGCTCCTCCCCTTGGCGCT |
| | | GTTGCTCCACGCAGCAAGGCCGCAGGTGCAGCTGGTGCAGAGC |
| | | GGCCCTGAGCTGAAGAAGCCCGGAGCCAGCGTGAAGATCTCCT |
| | | GCAAGACCTCCGGCTACACCTTCACCGAGTACACCATCAACTG |
| | | GGTGAAGCAGGCCCCCGGACAGGGACTGGAATGGATCGGCGA |
| | | CATCTACCCCGACAACTACAACATCAGGTACAACCAGAAGTTC |
| | | CAAGGCAAGGCCACCATCACAAGGGACACCAGCAGCAGCACC |
| | | GCCTACATGGAGCTGAGCAGCCTGAGGAGCGAGGATACCGCC |
| | | GTGTACTACTGCGCCAACCACGACTTCTTCGTGTTCTGGGGCCA |
| | | GGGCACCCTGGTGACAGTGAGCAGCGGAGGAGGCGGAAGCGG |
| | | AGGAGGAGGATCCGGAGGAGGAGGCAGCGACATCCAGATGAC |
| | | CCAGTCCCCCTCCTCCCTGAGCGCCTCCGTGGGAGACAGGGTG |
| | | ACCATCACCTGCCAGGCCAGCCAGGACATCAGCAACTACCTGA |
| | | ACTGGTACCAGCAGAAGCCCGGCAAGGCCCCCAAGCTGCTGAT |
| | | TTACTACACCAGCAGGCTGGAAACCGGCGTGCCCAGCAGATTT |
| | | AGCGGCAGCGGCAGCGGCACCGACTTTACCTTTACCATCTCCA |
| | | GCCTGCAGCCCGAGGATATCGCCACATACTACTGCCAGCAGGG |
| | | CAACACCCTCCCCCCTACCTTTGGCGGCGGCACCAAGGTGGAG |

TABLE 34-continued rAAV Sequences

| SEQ ID NO: | Description | Sequence |
|---|---|---|
| | | ATTAAGAGTGCTGCTGCCTTTGTCCCGGTATTTCTCCCAGCCAA
ACCGACCACGACTCCCGCCCCGCGCCCTCCGACACCCGCTCCC
ACCATCGCCTCTCAACCTCTTAGTCTTCGCCCCGAGGCATGCCG
ACCCGCCGCCGGGGGTGCTGTTCATACGAGGGGCTTGGACTTC
GCTTGTGATATTTACATTTGGGCTCCGTTGGCGGGTACGTGCGG
CGTCCTTTTGTTGTCACTCGTTATTACTTTGTATTGTAATCACAG
GAATCGCTCAAAGCGGAGTAGGTTGTTGCATTCCGATTACATG
AATATGACTCCTCGCCGGCCTGGGCCGACAAGAAAACATTACC
AACCCTATGCCCCCCCACGAGACTTCGCTGCGTACAGGTCCCG
AGTGAAGTTTTCCCGAAGCGCAGACGCTCCGGCATATCAGCAA
GGACAGAATCAGCTGTATAACGAACTGAATTTGGGACGCCGCG
AGGAGTATGACGTGCTTGATAAACGCCGGGGGAGAGACCCGG
AAATGGGGGTAAACCCCGAAGAAAGAATCCCCAAGAAGGAC
TCTACAATGAACTCCAGAAGGATAAGATGGCGGAGGCCTACTC
AGAAATAGGTATGAAGGGCGAACGACGACGGGGAAAAGGTCA
CGATGGCCTCTACCAAGGGTTGAGTACGGCAACCAAAGATACG
TACGATGCACTGCATATGCAGGCCCTGCCTCCCAGATAATAAT
AAAATCGCTATCCATCGAAGATGGATGTGTGTTGGTTTTTTGTG
TGTGGAGCAACAAATCTGACTTTGCATGTGCAAACGCCTTCAA
CAACAGCATTATTCCAGAAGACACCTTCTTCCCCAGCCCAGGT
AAGGGCAGCTTTGGTGCCTTCGCAGGCTGTTTCCTTGCTTCAGG
AATGCCAGGTTCTGCCCAGAGCTCTGGTCAATGATGTCTAAA
ACTCCTCTGATTGGTGGTCTCGGCCTTATCCATTGCCACCAAAA
CCCTCTTTTTACTAAGAAACAGTGAGCCTTGTTCTGGCAGTCCA
GAGAATGACACGGGAAAAAAGCAGATGAAGAGAAGGTGGCAG
GAGAGGGCACGTGGCCCAGCCTCAGTCTCTCCAACTGAGTTCC
TGCCTGCCTGCCTTTGCTCAGACTGTTTGCCCCTTACTGCTCTTC
TAGGCCTCATTCTAAGCCCCTTCTCCAAGTTGCCTCTCCTTATTT
CTCCCTGTCTGCCAAAAAATCTTTCCCAGCTCACTAAGTCAGTC
TCACGCAGTCACTCATTAACCCACCAATCACTGATTGTGCCGGC
ACATGAATGCACCAGGTGTTGAAGTGGAGGAATTAAAAAGTCA
GATGAGGGGTGTGCCCAGAGGAAGCACCATTCTAGTTGGGGGA
GCCCATCTGTCAGCTGGGAAAAGTCCAAATAACTTCAGATTGG
AATGTGTTTTAACTCAGGGTTGAGAAAACAGCTACCTTCAGGA
CAAAAGTCAGGGAAGGGCTCTCTGAAGAAATGCTACTTGAAGA
TACCAGCCCTACCAAGGGCAGGGAGAGGACCCTATAGAGGCCT
GGGACAGGAGCTCAATGAGAAAGGTAACCACGTGCGGACCGA
GGCTGCAGCGTCGTCCTCCCTAGGAACCCCTAGTGATGGAGTT
GGCCACTCCCTCTCTGCGCGCTCGCTCGCTCACTGAGGCCGGGC
GACCAAAGGTCGCCCGACGCCCGGGCTTTGCCCGGGCGGCCTC
AGTGAGCGAGCGAGCGCGCAGCTGCCTGCAGG |
| 1382 | CTX-175 | CCTGCAGGCAGCTGCGCGCTCGCTCGCTCACTGAGGCCGCCCG
GGCGTCGGGCGACCTTTGGTCGCCCGGCCTCAGTGAGCGAGCG
AGCGCGCAGAGAGGGAGTGGCCAACTCCATCACTAGGGGTTCC
TGCGGCCGCACGCGTGAGATGTAAGGAGCTGCTGTGACTTGCT
CAAGGCCTTATATCGAGTAAACGGTAGTGCTGGGGCTTAGACG
CAGGTGTTCTGATTTATAGTTCAAAACCTCTATCAATGAGAGA
GCAATCTCCTGGTAATGTGATAGATTTCCCAACTTAATGCCAAC
ATACCATAAACCTCCCATTCTGCTAATGCCCAGCCTAAGTTGGG
GAGACCACTCCAGATTCCAAGATGTACAGTTTGCTTTGCTGGG
CCTTTTTCCCATGCCTGCCTTTACTCTGCCAGAGTTATATTGCTG
GGGTTTTGAAGAAGATCCTATTAAATAAAAGAATAAGCAGTAT
TATTAAGTAGCCCTGCATTTCAGGTTTCCTTGAGTGGCAGGCCA
GGCCTGGCCGTGAACGTTCACTGAAATCATGGCCTCTTGGCCA
AGATTGATAGCTTGTGCCTGTCCCTGAGTCCCAGTCCATCACGA
GCAGCTGGTTTCTAAGATGCTATTTCCCGTATAAAGCATGAGA
CCGTGACTTGCCAGCCCCACAGAGCCCCGCCCTTGTCCATCACT
GGCATCTGGACTCCAGCCTGGGTTGGGGCAAAGAGGGAAATG
AGATCATGTCCTAACCCTGATCCTCTTGTCCCACAGATATCCAG
AACCCTGACCCTGCCGTGTACCAGCTGAGAGACTCTAAATCCA
GTGACAAGTCTGTCTGCCTATTCACCGATTTTGATTCTCAAACA
AATGTGTCACAAAGTAAGGATTCTGATGTGTATATCACAGACA
AAACTGTGCTAGACATGAGGTCTATGGACTTCAGGCTCCGGTG
CCCGTCAGTGGGCAGAGCGCACATCGCCCACAGTCCCGAGAA
GTTGGGGGAGGGGTCGGCAATTGAACCGGTGCCTAGAGAAG
GTGGCGCGGGGTAAACTGGGAAAGTGATGTCGTGTACTGGCTC
CGCCTTTTTCCCGAGGGTGGGGGAGAACCGTATATAAGTGCAG
TAGTCGCCGTGAACGTTCTTTTTCGCAACGGGTTTGCCGCCAGA
ACACAGGTAAGTGCCGTGTGTGGTTCCCGCGGGCCTGGCCTCT
TTACGGGTTATGGCCCTTGCGTGCCTTGAATTACTTCCACTGGC
TGCAGTACGTGATTCTTGATCCCGAGCTTCGGGTTGGAAGTGG
GTGGGAGAGTTCGAGGCCTTGCGCTTAAGGAGCCCCTTCGCCT
CGTGCTTGAGTTGAGGCCTGGCCTGGGCGCTGGGGCCGCCGCG
TGCGAATCGGTGGCACCTTCGCGCCTGTCTCGCTGCTTTCGAT
AAGTCTCTAGCCATTTAAAATTTTTGATGACCTGCTGCGACGCT |

TABLE 34-continued rAAV Sequences

| SEQ ID NO: | Description | Sequence |
|---|---|---|
| | | TTTTTTCTGGCAAGATAGTCTTGTAAATGCGGGCCAAGATCTGC
ACACTGGTATTTCGGTTTTTGGGGCCGCGGGCGGCGACGGGGC
CCGTGCGTCCCAGCGCACATGTTCGGCGAGGCGGGGCCTGCGA
GCGCGGCCACCGAGAATCGGACGGGGGTAGTCTCAAGCTGGCC
GGCCTGCTCTGGTGCCTGGCCTCGCGCCGCCGTGTATCGCCCCG
CCCTGGGCGGCAAGGCTGGCCCGGTCGGCACCAGTTGCGTGAG
CGGAAAGATGGCCGCTTCCCGGCCCTGCTGCAGGGAGCTCAAA
ATGGAGGACGCGGCGCTCGGGAGAGCGGGCGGGTGAGTCACC
CACACAAAGGAAAAGGGCCTTTCCGTCCTCAGCCGTCGCTTCA
TGTGACTCCACGGAGTACCGGGCGCCGTCCAGGCACCTCGATT
AGTTCTCGAGCTTTTGGAGTACGTCGTCTTTAGGTTGGGGGGAG
GGGTTTTATGCGATGGAGTTTCCCCACACTGAGTGGGTGGAGA
CTGAAGTTAGGCCAGCTTGGCACTTGATGTAATTCTCCTTGGAA
TTTGCCCTTTTTGAGTTTGGATCTTGGTTCATTCTCAAGCCTCAG
ACAGTGGTTCAAAGTTTTTTTCTTCCATTTCAGGTGTCGTGACC
ACCATGGCGCTTCCGGTGACAGCACTGCTCCTCCCCTTGGCGCT
GTTGCTCCACGCAGCAAGGCCGCAGGTGCAGCTGGTGCAGTCC
GGCCCCGAACTGAAAAAGCCCGGCGCCAGCGTCAAGATCAGCT
GCAAGACCTCCGGCTACACCTTCACCGAGTACACCATCAACTG
GGTGAAGCAGGCCCCCGGCCAGGGACTGGAATGGATTGGCGA
CATCTACCCCGACAACTACAACATTAGGTATAACCAGAAGTTC
CAGGGCAAGGCCACCATCACAAGAGACACCAGCAGCAGCACC
GCCTACATGGAGCTGAGCAGCCTGAGGAGCGAGGACACCGCC
GTGTACTACTGCGCCAACCACGACTTCTTCGTGTTCTGGGGCCA
GGGAACCCTGGTGACAGTGTCCAGCGGCGGCGGCGGCTCCGGC
GGCGGCGGCTCCGGCGGCGGCGGCAGCGACATTCAGATGACA
CAGAGCCCCTCCAGCCTGAGCGCCAGCCTGGGCGATAGGGTGA
CCATCACCTGCAGAACCAGCCAGGACATCAGCAACCACCTGAA
TTGGTACCAGCAGAAGCCCGGAAAGGCCCCCAAACTGCTGATC
TACTACACCAGCAGGCTGGAGAGCGGCGTGCCTAGCAGGTTTA
GCGGCAGCGGCAGCGGCACAGATTACAGCCTGACCATCAGCA
GCCTGCAGCCCGAAGACATCGGCACCTACTACTGCCAGCAGGG
CAACACCCTGCCCCCTACCTTTGGCGGAGGCACCAAGCTGGAG
ATCAAGAGTGCTGCTGCCTTTGTCCCGGTATTTCTCCCAGCCAA
ACCGACCACGACTCCCGCCCCGCGCCCTCCGACACCCGCTCCC
ACCATCGCCTCTCAACCTCTTAGTCTTCGCCCCGAGGCATGCCG
ACCCGCCGCCGGGGGTGCTGTTCATACGAGGGGCTTGGACTTC
GCTTGTGATATTTACATTTGGGCTCCGTTGGCGGGTACGTGCGG
CGTCCTTTTGTTGTCACTCGTTATTACTTTGTATTGTAATCACAG
GAATCGCTCAAAGCGGAGTAGGTTGTTGCATTCCGATTACATG
AATATGACTCCTCGCCGGCCTGGGCCGACAAGAAAACATTACC
AACCCTATGCCCCCCACGAGACTTCGCTGCGTACAGGTCCCG
AGTGAAGTTTTCCCGAAGCGCAGACGCTCCGGCATATCAGCAA
GGACAGAATCAGCTGTATAACGAACTGAATTTGGGACGCCGCG
AGGAGTATGACGTGCTTGATAAACGCCGGGGGAGAGACCCGG
AAATGGGGGGTAAACCCCGAAGAAAGAATCCCCAAGAAGGAC
TCTACAATGAACTCCAGAAGGATAAGATGGCGGAGGCCTACTC
AGAAATAGGTATGAAGGGCGAACGACGACGGGGAAAAGGTCA
CGATGGCCTCTACCAAGGGTTGAGTACGGCAACCAAAGATACG
TACGATGCACTGCATATGCAGGCCCTGCCTCCCAGATAATAAT
AAAATCGCTATCCATCGAAGATGGATGTGTGTTGGTTTTTTGTG
TGTGGAGCAACAAATCTGACTTTGCATGTGCAAACGCCTTCAA
CAACAGCATTATTCCAGAAGACACCTTCTTCCCCAGCCCAGGT
AAGGGCAGCTTTGGTGCCTTCGCAGGCTGTTTCCTTGCTTCAGG
AATGGCCAGGTTCTGCCCAGAGCTCTGGTCAATGATGTCTAAA
ACTCCTCTGATTGGTGGTCTCGGCCTTATCCATTGCCACCAAAA
CCCTCTTTTTACTAAGAAACAGTGAGCCTTGTTCTGGCAGTCCA
GAGAATGACACGGGAAAAAAGCAGATGAAGAGAAGGTGGCAG
GAGAGGGCACGTGGCCCAGCCTCAGTCTCTCCAACTGAGTTCC
TGCCTGCCTGCCTTTGCTCAGACTGTTTGCCCCTTACTGCTCTTC
TAGGCCTCATTCTAAGCCCCTTCTCCAAGTTGCCTCTCCTTATTT
CTCCCTGTCTGCCAAAAAATCTTTCCCAGCTCACTAAGTCAGTC
TCACGCAGTCACTCATTAACCCACCAATCACTGATTGTGCCGGC
ACATGAATGCACCAGGTGTTGAAGTGGAGGAATTAAAAAGTCA
GATGAGGGGTGTGCCCAGAGGAAGCACCATTCTAGTTGGGGGA
GCCCATCTGTCAGCTGGGAAAAGTCCAAATAACTTCAGATTGG
AATGTGTTTTAACTCAGGGTTGAGAAAACAGCTACCTTCAGGA
CAAAAGTCAGGGAAGGGCTCTCTGAAGAAATGCTACTTGAAGA
TACCAGCCCTACCAAGGGCAGGGAGAGGACCCTATAGAGGCCT
GGGACAGGAGCTCAATGAGAAAGGTAACCACGTGCGGACCGA
GGCTGCAGCGTCGTCCTCCCTAGGAACCCCTAGTGATGGAGTT
GGCCACTCCCTCTCTGCGCGCTCGCTCGCTCACTGAGGCCGGGC
GACCAAAGGTCGCCCGACGCCCGGGCTTTGCCCGGGCGGCCTC
AGTGAGCGAGCGAGCGCGCAGCTGCCTGCAGG |

TABLE 34-continued rAAV Sequences

| SEQ ID NO: | Description | Sequence |
|---|---|---|
| 1383 | CTX-176 | CCTGCAGGCAGCTGCGCGCTCGCTCGCTCACTGAGGCCGCCCG<br>GGCGTCGGGCGACCTTTGGTCGCCCGGCCTCAGTGAGCGAGCG<br>AGCGCGCAGAGAGGGAGTGGCCAACTCCATCACTAGGGGTTCC<br>TGCGGCCGCACGCGTGAGATGTAAGGAGCTGCTGTGACTTGCT<br>CAAGGCCTTATATCGAGTAAACGGTAGTGCTGGGGCTTAGACG<br>CAGGTGTTCTGATTTATAGTTCAAAACCTCTATCAATGAGAGA<br>GCAATCTCCTGGTAATGTGATAGATTTCCCAACTTAATGCCAAC<br>ATACCATAAACCTCCCATTCTGCTAATGCCCAGCCTAAGTTGGG<br>GAGACCACTCCAGATTCCAAGATGTACAGTTTGCTTTGCTGGG<br>CCTTTTTCCCATGCCTGCCTTTACTCTGCCAGAGTTATATTGCTG<br>GGGTTTTGAAGAAGATCCTATTAAATAAAAGAATAAGCAGTAT<br>TATTAAGTAGCCCTGCATTTCAGGTTTCCTTGAGTGGCAGGCCA<br>GGCCTGGCCGTGAACGTTCACTGAAATCATGGCCTCTTGGCCA<br>AGATTGATAGCTTGTGCCTGTCCCTGAGTCCCAGTCCATCACGA<br>GCAGCTGGTTTCTAAGATGCTATTTCCCGTATAAAGCATGAGA<br>CCGTGACTTGCCAGCCCCACAGAGCCCCGCCCTTGTCCATCACT<br>GGCATCTGGACTCCAGCCTGGGTTGGGGCAAAGAGGGAAATG<br>AGATCATGTCCTAACCCTGATCCTCTTGTCCCACAGATATCCAG<br>AACCCTGACCCTGCCGTGTACCAGCTGAGAGACTCTAAATCCA<br>GTGACAAGTCTGTCTGCCTATTCACCGATTTTGATTCTCAAACA<br>AATGTGTCACAAAGTAAGGATTCTGATGTGTATATCACAGACA<br>AAACTGTGCTAGACATGAGGTCTATGGACTTCAGGCTCCGGTG<br>CCCGTCAGTGGGCAGAGCGCACATCGCCCACAGTCCCCGAGAA<br>GTTGGGGGGAGGGGTCGGCAATTGAACCGGTGCCTAGAGAAG<br>GTGGCGCGGGGTAAACTGGGAAAGTGATGTCGTGTACTGGCTC<br>CGCCTTTTTCCCGAGGGTGGGGGAGAACCGTATATAAGTGCAG<br>TAGTCGCCGTGAACGTTCTTTTTCGCAACGGGTTTGCCGCCAGA<br>ACACAGGTAAGTGCCGTGTGTGGTTCCCGCGGGCCTGGCCTCT<br>TTACGGGTTATGGCCCTTGCGTGCCTTGAATTACTTCCACTGGC<br>TGCAGTACGTGATTCTTGATCCCGAGCTTCGGGTTGGAAGTGG<br>GTGGGAGAGTTCGAGGCCTTGCGCTTAAGGAGCCCCTTCGCCT<br>CGTGCTTGAGTTGAGGCCTGGCCTGGGCGCTGGGGCCGCCGCG<br>TGCGAATCTGGTGGCACCTTCGCGCCTGTCTCGCTGCTTTCGAT<br>AAGTCTCTAGCCATTTAAAATTTTTGATGACCTGCTGCGACGCT<br>TTTTTTCTGGCAAGATAGTCTTGTAAATGCGGGCCAAGATCTGC<br>ACACTGGTATTTCGGTTTTTGGGGCCGCGGGCGGCGACGGGGC<br>CCGTGCGTCCCAGCGCACATGTTCGGCGAGGCGGGGCCTGCGA<br>GCGCGGCCACCGAGAATCGGACGGGGGTAGTCTCAAGCTGGCC<br>GGCCTGCTCTGGTGCCTGGCCTCGCGCCGCCGTGTATCGCCCCG<br>CCCTGGGCGGCAAGGCTGGCCCGGTCGGCACCAGTTGCGTGAG<br>CGGAAAGATGGCCGCTTCCCGGCCCTGCTGCAGGGAGCTCAAA<br>ATGGAGGACGCGGCGCTCGGGAGAGCGGGCGGGTGAGTCACC<br>CACACAAAGGAAAAGGGCCTTTCCGTCCTCAGCCGTCGCTTCA<br>TGTGACTCCACGGAGTACCGGGCGCCGTCCAGGCACCTCGATT<br>AGTTCTCGAGCTTTTGGAGTACGTCGTCTTTAGGTTGGGGGGAG<br>GGGTTTTATGCGATGGAGTTTCCCCACACTGAGTGGGTGGAGA<br>CTGAAGTTAGGCCAGCTTGGCACTTGATGTAATTCTCCTTGGAA<br>TTTGCCCTTTTTGAGTTTGGATCTTGGTTCATTCTCAAGCCTCAG<br>ACAGTGGTTCAAAGTTTTTTTCTTCCATTTCAGGTGTCGTGACC<br>ACCATGGCGCTTCCGGTGACAGCACTGCTCCTCCCCTTGGCGCT<br>GTTGCTCCACGCAGCAAGGCCGGACATCCAGATGACACAGAGC<br>CCTAGCAGCCTGAGCGCTTCCGTGGGCGACAGGGTGACCATCA<br>CCTGCCAGGCCAGCCAGGACATCAGCAACTACCTCAACTGGTA<br>CCAGCAGAAGCCCGGCAAGGCCCCTAAGCTGCTGATCTACTAC<br>ACCTCCAGGCTGGAGACCGGAGTGCCCTCCAGATTTTCCGGCA<br>GCGGCAGCGGCACCGATTTCACCTTCACCATCAGCAGCCTGCA<br>GCCCGAGGACATCGCCACCTACTATTGCCAGCAGGGCAACACC<br>CTGCCCCCCACATTTGGAGGCGGCACCAAGGTGGAGATCAAGG<br>GCGGAGGAGGAAGCGGAGGAGGAGGAAGCGGAGGAGGCGGA<br>AGCCAGGTGCAGCTGGTGCAGAGCGGCGCTGAGCTCAAGAAG<br>CCTGGCGCCAGCGTGAAGATCAGCTGCAAAGCCTCCGGATACA<br>CCTTCACCGAGTACACCATCAATTGGGTGAGACAGGCCCCCGG<br>CCAAAGACTGGAGTGGATGGGCGACATCTATCCCGACAACTAC<br>AGCATCAGGTACAACCAGAAGTTCCAGGGCAGGGTGACAATC<br>ACCAGAGACACCAGCGCCAGCACCGCCTACATGGAGCTGAGC<br>AGCCTGAGGAGCGAGGACACCGCCGTGTACTACTGCGCCAATC<br>ACGACTTCTTCGTGTTCTGGGGCCAGGGAACCCTGGTGACCGT<br>CAGCTCCAGTGCTGCTGCCTTTGTCCCGGTATTTCTCCCAGCCA<br>AACCGACCACGACTCCCGCCCCGCGCCCTCCGACACCCGCTCC<br>CACCCATCGCCTCTCAACCTCTTAGTCTTCGCCCCGAGGCATGCC<br>GACCCGCCGCCGGGGTGCTGTTCATACGAGGGGCTTGGACTT<br>CGCTTGTGATATTTACATTTGGGCTCCGTTGGCGGGTACGTGCG<br>GCGTCCTTTTGTTGTCACTCGTTATTACTTTGTATTGTAATCACA<br>GGAATCGCTCAAAGCGGAGTAGGTTGTTGCATTCCGATTACAT<br>GAATATGACTCCTCGCCGGCCTGGGCCGACAAGAAAACATTAC |

TABLE 34-continued rAAV Sequences

| SEQ ID NO: | Description | Sequence |
|---|---|---|
| | | CAACCCTATGCCCCCCCACGAGACTTCGCTGCGTACAGGTCCC<br>GAGTGAAGTTTTCCCGAAGCGCAGACGCTCCGGCATATCAGCA<br>AGGACAGAATCAGCTGTATAACGAACTGAATTTGGGACGCCGC<br>GAGGAGTATGACGTGCTTGATAAACGCCGGGGGAGAGACCCG<br>GAAATGGGGGGTAAACCCCGAAGAAAGAATCCCCAAGAAGGA<br>CTCTACAATGAACTCCAGAAGGATAAGATGGCGGAGGCCTACT<br>CAGAAATAGGTATGAAGGGCGAACGACGACGGGGAAAAGGTC<br>ACGATGGCCTCTACCAAGGGTTGAGTACGGCAACCAAAGATAC<br>GTACGATGCACTGCATATGCAGGCCCTGCCTCCCAGATAATAA<br>TAAAATCGCTATCCATCGAAGATGGATGTGTGTTGGTTTTTTGT<br>GTGTGGAGCAACAAATCTGACTTTGCATGTGCAAACGCCTTCA<br>ACAACAGCATTATTCCAGAAGACACCTTCTTCCCCAGCCCAGG<br>TAAGGGCAGCTTTGGTGCCTTCGCAGGCTGTTTCCTTGCTTCAG<br>GAATGGCCAGGTTCTGCCCAGAGCTCTGGTCAATGATGTCTAA<br>AACTCCTCTGATTGGTGGTCTCGGCCTTATCCATTGCCACCAAA<br>ACCCTCTTTTTACTAAGAAACAGTGAGCCTTGTTCTGGCAGTCC<br>AGAGAATGACACGGGAAAAAAGCAGATGAAGAGAAGGTGGCA<br>GGAGAGGGCACGTGGCCCAGCCTCAGTCTCTCCAACTGAGTTC<br>CTGCCTGCCTGCCTTTGCTCAGACTGTTTGCCCCTTACTGCTCTT<br>CTAGGCCTCATTCTAAGCCCCTTCTCCAAGTTGCCTCTCCTTATT<br>TCTCCCTGTCTGCCAAAAAATCTTTCCCAGCTCACTAAGTCAGT<br>CTCACGCAGTCACTCATTAACCCACCAATCACTGATTGTGCCGG<br>CACATGAATGCACCAGGTGTTGAAGTGGAGGAATTAAAAAGTC<br>AGATGAGGGGTGTGCCCAGAGGAAGCACCATTCTAGTTGGGGG<br>AGCCCATCTGTCAGCTGGGAAAAGTCCAAATAACTTCAGATTG<br>GAATGTGTTTTAACTCAGGGTTGAGAAAACAGCTACCTTCAGG<br>ACAAAAGTCAGGGAAGGGCTCTCTGAAGAAATGCTACTTGAAG<br>ATACCAGCCCTACCAAGGGCAGGGAGAGGACCCTATAGAGGC<br>CTGGGACAGGAGCTCAATGAGAAAGGTAACCACGTGCGGACC<br>GAGGCTGCAGCGTCGTCCTCCCTAGGAACCCCTAGTGATGGAG<br>TTGGCCACTCCCTCTCTGCGCGCTCGCTCGCTCACTGAGGCCGG<br>GCGACCAAAGGTCGCCCGACGCCCGGGCTTTGCCCGGGCGGCC<br>TCAGTGAGCGAGCGAGCGCGCAGCTGCCTGCAGG |
| 1384 | CTX-177 | CCTGCAGGCAGCTGCGCGCTCGCTCGCTCACTGAGGCCGCCCG<br>GGCGTCGGGCGACCTTTGGTCGCCCGGCCTCAGTGAGCGAGCG<br>AGCGCGCAGAGAGGGAGTGGCCAACTCCATCACTAGGGGTTCC<br>TGCCGGCCGCACGCGTGAGATGTAAGGAGCTGCTGTGACTTGCT<br>CAAGGCCTTATATCGAGTAAACGGTAGTGCTGGGGCTTAGACG<br>CAGGTGTTCTGATTTATAGTTCAAAACCTCTATCAATGAGAGA<br>GCAATCTCCTGGTAATGTGATAGATTTCCCAACTTAATGCCAAC<br>ATACCATAAACCTCCCATTCTGCTAATGCCCAGCCTAAGTTGGG<br>GAGACCACTCCAGATTCCAAGATGTACAGTTTGCTTTGCTGGG<br>CCTTTTTCCCATGCCTGCCTTTACTCTGCCAGAGTTATATTGCTG<br>GGGTTTTGAAGAAGATCCTATTAAATAAAAGAATAAGCAGTAT<br>TATTAAGTAGCCCTGCATTTCAGGTTTCCTTGAGTGGCAGGCCA<br>GGCCTGGCCGTGAACGTTCACTGAAATCATGGCCTCTTGGCCA<br>AGATTGATAGCTTGTGCCTGTCCCTGAGTCCCAGTCCATCACGA<br>GCAGCTGGTTTCTAAGATGCTATTTCCCGTATAAAGCATGAGA<br>CCGTGACTTGCCAGCCCCACAGAGCCCCGCCCTTGTCCATCACT<br>GGCATCTGGACTCCAGCCTGGGTTGGGGCAAAGAGGGAAATG<br>AGATCATGTCCTAACCCTGATCCTCTTGTCCCACAGATATCCAG<br>AACCCTGACCCTGCCGTGTACCAGCTGAGAGACTCTAAATCCA<br>GTGACAAGTCTGTCTGCCTATTCACCGATTTTGATTCTCAAACA<br>AATGTGTCACAAAGTAAGGATTCTGATGTGTATATCACAGACA<br>AAACTGTGCTAGACATGAGGTCTATGGACTTCAGGCTCCGGTG<br>CCCGTCAGTGGGCAGAGCGCACATCGCCCACAGTCCCCGAGAA<br>GTTGGGGGGAGGGGTCGGCAATTGAACCGGTGCCTAGAGAAG<br>GTGGCGCGGGGTAAACTGGGAAAGTGATGTCGTGTACTGGCTC<br>CGCCTTTTTCCCGAGGGTGGGGGAGAACCGTATATAAGTGCAG<br>TAGTCGCCGTGAACGTTCTTTTTCGCAACGGGTTTGCCGCCAGA<br>ACACAGGTAAGTGCCGTGTGTGGTTCCCGCGGGCCTGGCCTCT<br>TTACGGGTTATGGCCCTTGCGTGCCTTGAATTACTTCCACTGGC<br>TGCAGTACGTGATTCTTGATCCCGAGCTTCGGGTTGGAAGTGG<br>GTGGGAGAGTTCGAGGCCTTGCGCTTAAGGAGCCCCTTCGCCT<br>CGTGCTTGAGTTGAGGCCTGGCCTGGGCGCTGGGGCCGCCGCG<br>TGCGAATCTGGTGGCACCTTCGCGCCTGTCTCGCTGCTTTCGAT<br>AAGTCTCTAGCCATTTAAAATTTTTGATGACCTGCTGCGACGCT<br>TTTTTTCTGGCAAGATAGTCTTGTAAATGCGGGCCAAGATCTGC<br>ACACTGGTATTTCGGTTTTTGGGCCGCGGGCGGCGACGGGGC<br>CCGTGCGTCCCAGCGCACATGTTCGGCGAGGCGGGCCTGCGA<br>GCGCGGCCACCGAGAATCGGACGGGGGTAGTCTCAAGCTGGCC<br>GGCCTGCTCTGGTGCCTGGCCTCGCGCCGCCGTGTATCGCCCCG<br>CCCTGGGCGGCAAGGCTGGCCCGGTCGGCACCAGTTGCGTGAG<br>CGGAAAGATGGCCGCTTCCCGGCCCTGCTGCAGGGAGCTCAAA<br>ATGGAGGACGCGGCGCTCGGGAGAGCGGGCGGGTGAGTCACC |

TABLE 34-continued rAAV Sequences

| SEQ ID NO: | Description | Sequence |
|---|---|---|
| | | CACACAAAGGAAAAGGGCCTTTCCGTCCTCAGCCGTCGCTTCA |
| | | TGTGACTCCACGGAGTACCGGGCGCCGTCCAGGCACCTCGATT |
| | | AGTTCTCGAGCTTTTGGAGTACGTCGTCTTTAGGTTGGGGGGAG |
| | | GGGTTTTATGCGATGGAGTTTCCCCACACTGAGTGGGTGGAGA |
| | | CTGAAGTTAGGCCAGCTTGGCACTTGATGTAATTCTCCTTGGAA |
| | | TTTGCCCTTTTTGAGTTTGGATCTTGGTTCATTCTCAAGCCTCAG |
| | | ACAGTGGTTCAAAGTTTTTTTCTTCCATTTCAGGTGTCGTGACC |
| | | ACCATGGCGCTTCCGGTGACAGCACTGCTCCTCCCCTTGGCGCT |
| | | GTTGCTCCACGCAGCAAGGCCGGATATCCAGATGACACAGAGC |
| | | CCTAGCTCCCTGAGCGCCAGCCTGGGCGATAGGGTGACCATCA |
| | | CCTGCAGGACCTCCCAGGACATCAGCAACCACCTGAACTGGTA |
| | | CCAGCAGAAGCCCGGCAAAGCCCCCAAGCTGCTGATCTACTAC |
| | | ACCAGCAGGCTGGAAAGCGGCGTGCCCAGCAGGTTTAGCGGA |
| | | AGCGGCAGCGGCACCGACTACAGCCTGACCATCAGCTCCCTGC |
| | | AGCCCGAGGACATCGGCACCTACTACTGCCAGCAGGGCAACAC |
| | | CCTGCCTCCCACCTTCGGAGGCGGAACCAAGCTGGAGATTAAG |
| | | GGAGGCGGCGGAAGCGGCGGCGGCGGCTCCGGCGGAGGAGGC |
| | | AGCCAGGTGCAGCTGGTGCAGTCCGGAGCCGAGCTGAAAAAG |
| | | CCTGGCGCCAGCGTGAAGATCAGCTGCAAGGCCAGCGGCTACA |
| | | CCTTCACCGAGTACACCATCAACTGGGTGAGGCAGGCCCCTGG |
| | | CCAGAGACTCGAGTGGATGGGCGACATCTACCCCGACAACTAC |
| | | TCCATCAGGTACAACCAGAAGTTTCAGGGCAGGGTGACCATTA |
| | | CCAGGGACACCAGCGCCAGCACAGCCTACATGGAGCTGAGCA |
| | | GCCTGAGGAGCGAGGATACAGCCGTCTACTACTGCGCCAACCA |
| | | CGACTTTTTCGTGTTCTGGGGACAGGGCACCCTGGTGACCGTGT |
| | | CCTCCAGTGCTGCTGCCTTTGTCCCGGTATTTCTCCCAGCCAAA |
| | | CCGACCACGACTCCCGCCCCGCGCCCTCCGACACCCGCTCCCA |
| | | CCATCGCCTCTCAACCTCTTAGTCTTCGCCCCGAGGCATGCCGA |
| | | CCCGCCGCCGGGGTGCTGTTCATACGAGGGGCTTGGACTTCG |
| | | CTTGTGATATTTACATTTGGGCTCCGTTGGCGGGTACGTGCGGC |
| | | GTCCTTTTGTTGTCACTCGTTATTACTTTGTATTGTAATCACAGG |
| | | AATCGCTCAAAGCGGAGTAGGTTGTTGCATTCCGATTACATGA |
| | | ATATGACTCCTCGCCGGCCTGGGCCGACAAGAAAACATTACCA |
| | | ACCCTATGCCCCCCCACGAGACTTCGCTGCGTACAGGTCCCGA |
| | | GTGAAGTTTTCCCGAAGCGCAGACGCTCCGGCATATCAGCAAG |
| | | GACAGAATCAGCTGTATAACGAACTGAATTTGGGACGCCGCGA |
| | | GGAGTATGACGTGCTTGATAAACGCCGGGGAGAGACCCCGGA |
| | | AATGGGGGGTAAACCCCGAAGAAAGAATCCCCAAGAAGGACT |
| | | CTACAATGAACTCCAGAAGGATAAGATGGCGGAGGCCTACTCA |
| | | GAAATAGGTATGAAGGGCGAACGACGACGGGGAAAAGGTCAC |
| | | GATGGCCTCTACCAAGGGTTGAGTACGGCAACCAAAGATACGT |
| | | ACGATGCACTGCATATGCAGGCCCTGCCTCCCAGATAATAATA |
| | | AAATCGCTATCCATCGAAGATGGATGTGTGTTGGTTTTTTGTGT |
| | | GTGGAGCAACAAATCTGACTTTGCATGTGCAAACGCCTTCAAC |
| | | AACAGCATTATTCCAGAAGACACCTTCTTCCCCAGCCCAGGTA |
| | | AGGGCAGCTTTGGTGCCTTCGCAGGCTGTTTCCTTGCTTCAGGA |
| | | ATGGCCAGGTTCTGCCCAGAGCTCTGGTCAATGATGTCTAAAA |
| | | CTCCTCTGATTGGTGGTCTCGGCCTTATCCATTGCCACCAAAAC |
| | | CCTCTTTTTACTAAGAAACAGTGAGCCTTGTTCTGGCAGTCCAG |
| | | AGAATGACACGGGAAAAAAGCAGATGAAGAGAAGGTGGCAGG |
| | | AGAGGGCACGTGGCCCAGCCTCAGTCTCTCCAACTGAGTTCCT |
| | | GCCTGCCTGCCTTTGCTCAGACTGTTTGCCCCTTACTGCTCTTCT |
| | | AGGCCTCATTCTAAGCCCCTTCTCCAAGTTGCCTCTCCTTATTTC |
| | | TCCCTGTCTGCCAAAAAATCTTTCCCAGCTCACTAAGTCAGTCT |
| | | CACGCAGTCACTCATTAACCCACCAATCACTGATTGTGCCGGC |
| | | ACATGAATGCACCAGGTGTTGAAGTGGAGGAATTAAAAAGTCA |
| | | GATGAGGGGTGTGCCCAGAGGAAGCACCATTCTAGTTGGGGGA |
| | | GCCCATCTGTCAGCTGGGAAAAGTCCAAATAACTTCAGATTGG |
| | | AATGTGTTTTAACTCAGGGTTGAGAAAACAGCTACCTTCAGGA |
| | | CAAAAGTCAGGGAAGGGCTCTCTGAAGAAATGCTACTTGAAGA |
| | | TACCAGCCCTACCAAGGGCAGGGAGAGGACCCTATAGAGGCCT |
| | | GGGACAGGAGCTCAATGAGAAAGGTAACCACGTGCGGACCGA |
| | | GGCTGCAGCGTCGTCCTCCCTAGGAACCCCTAGTGATGGAGTT |
| | | GGCCACTCCCTCTCTGCGCGCTCGCTCGCTCACTGAGGCCGGGC |
| | | GACCAAAGGTCGCCCGACGCCCGGGCTTTGCCCGGGCGGCCTC |
| | | AGTGAGCGAGCGAGCGCGCAGCTGCCTGCAGG |
| 1385 | CTX-178 | CCTGCAGGCAGCTGCGCGCTCGCTCGCTCACTGAGGCCGCCCG |
| | | GGCGTCGGGCGACCTTTGGTCGCCCGGCCTCAGTGAGCGAGCG |
| | | AGCGCGCAGAGAGGGAGTGGCCAACTCCATCACTAGGGGTTCC |
| | | TGCGGCCGCACGCGTGAGATGTAAGGAGCTGCTGTGACTTGCT |
| | | CAAGGCCTTATATCGAGTAAACGGTAGTGCTGGGGCTTAGACG |
| | | CAGGTGTTCTGATTTATAGTTCAAAACCTCTATCAATGAGAGA |
| | | GCAATCTCCTGGTAATGTGATAGATTTCCCAACTTAATGCCAAC |
| | | ATACCATAAACCTCCCATTCTGCTAATGCCCAGCCTAAGTTGGG |
| | | GAGACCACTCCAGATTCCAAGATGTACAGTTTGCTTTGCTGGG |

TABLE 34-continued rAAV Sequences

| SEQ ID NO:Description | Sequence |
|---|---|
| | CCTTTTTCCCATGCCTGCCTTTACTCTGCCAGAGTTATATTGCTG |
| | GGGTTTTGAAGAAGATCCTATTAAATAAAAGAATAAGCAGTAT |
| | TATTAAGTAGCCCTGCATTTCAGGTTTCCTTGAGTGGCAGGCCA |
| | GGCCTGGCCGTGAACGTTCACTGAAATCATGGCCTCTTGGCCA |
| | AGATTGATAGCTTGTGCCTGTCCCTGAGTCCCAGTCCATCACGA |
| | GCAGCTGGTTTCTAAGATGCTATTTCCCGTATAAAGCATGAGA |
| | CCGTGACTTGCCAGCCCCACAGAGCCCCGCCCTTGTCCATCACT |
| | GGCATCTGGACTCCAGCCTGGGTTGGGGCAAAGAGGGAAATG |
| | AGATCATGTCCTAACCCTGATCCTCTTGTCCCACAGATATCCAG |
| | AACCCTGACCCTGCCGTGTACCAGCTGAGAGACTCTAAATCCA |
| | GTGACAAGTCTGTCTGCCTATTCACCGATTTTGATTCTCAAACA |
| | AATGTGTCACAAAGTAAGGATTCTGATGTGTATATCACAGACA |
| | AAACTGTGCTAGACATGAGGTCTATGGACTTCAGGCTCCGGTG |
| | CCCGTCAGTGGGCAGAGCGCACATCGCCCACAGTCCCCGAGAA |
| | GTTGGGGGGAGGGGTCGGCAATTGAACCGGTGCCTAGAGAAG |
| | GTGGCGCGGGGTAAACTGGGAAAGTGATGTCGTGTACTGGCTC |
| | CGCCTTTTTCCCGAGGGTGGGGGAGAACCGTATATAAGTGCAG |
| | TAGTCGCCGTGAACGTTCTTTTTTCGCAACGGGTTTGCCGCCAGA |
| | ACACAGGTAAGTGCCGTGTGTGGTTCCCGCGGGCCTGGCCTCT |
| | TTACGGGTTATGGCCCTTGCGTGCCTTGAATTACTTCCACTGGC |
| | TGCAGTACGTGATTCTTGATCCCGAGCTTCGGGTTGGAAGTGG |
| | GTGGGAGAGTTCGAGGCCTTGCGCTTAAGGAGCCCCTTCGCCT |
| | CGTGCTTGAGTTGAGGCCTGGCCTGGGCGCTGGGGCCGCCGCG |
| | TGCGAATCTGGTGGCACCTTCGCGCCTGTCTCGCTGCTTTCGAT |
| | AAGTCTCTAGCCATTTAAAATTTTTGATGACCTGCTGCGACGCT |
| | TTTTTTCTGGCAAGATAGTCTTGTAAATGCGGGCCAAGATCTGC |
| | ACACTGGTATTTCGGTTTTTGGGGCCGCGGGCGGCGACGGGGC |
| | CCGTGCGTCCCAGCGCACATGTTCGGCGAGGCGGGGCCTGCGA |
| | GCGCGGCCACCGAGAATCGGACGGGGGTAGTCTCAAGCTGGCC |
| | GGCCTGCTCTGGTGCCTGGCCTCGCGCCGCCGTGTATCGCCCCG |
| | CCCTGGGCGGCAAGGCTGGCCCGGTCGGCACCAGTTGCGTGAG |
| | CGGAAAGATGGCCGCTTCCCGGCCCTGCTGCAGGGAGCTCAAA |
| | ATGGAGGACGCGGCGCTCGGGAGAGCGGGCGGGTGAGTCACC |
| | CACACAAAGGAAAAGGGCCTTTCCGTCCTCAGCCGTCGCTTCA |
| | TGTGACTCCACGGAGTACCGGGCGCCGTCCAGGCACCTCGATT |
| | AGTTCTCGAGCTTTTGGAGTACGTCGTCTTTAGGTTGGGGGGAG |
| | GGGTTTTATGCGATGGAGTTTCCCCACACTGAGTGGGTGGAGA |
| | CTGAAGTTAGGCCAGCTTGGCACTTGATGTAATTCTCCTTGGAA |
| | TTTGCCCTTTTTGAGTTTGGATCTTGGTTCATTCTCAAGCCTCAG |
| | ACAGTGGTTCAAAGTTTTTTTCTTCCATTTCAGGTGTCGTGACC |
| | ACCATGGCGCTTCCGGTGACAGCACTGCTCCTCCCCTTGGCGCT |
| | GTTGCTCCACGCAGCAAGGCCGGACATCCAAATGACCCAGAGC |
| | CCTAGCTCCCTGAGCGCTTCCGTGGGCGACAGAGTGACCATTA |
| | CCTGCCAGGCCAGCCAGGACATCAGCAACTACCTGAACTGGTA |
| | TCAGCAGAAGCCTGGCAAGGCCCCCAAGCTGCTGATCTACTAC |
| | ACCAGCAGGCTGGAGACCGGAGTGCCCAGCAGGTTTAGCGGCT |
| | CCGGATCCGGCACCGACTTCACCTTCACCATCTCCAGCCTGCAG |
| | CCCGAGGACATCGCCACCTACTACTGCCAGCAGGGCAATACCC |
| | TCCCCCCTACCTTCGGAGGCGGCACCAAGGTGGAGATCAAGGG |
| | CGGCGGCGGCTCCGGCGGCGGCGGCAGCGGCGGAGGCGGCAG |
| | CCAGGTGCAACTGGTGCAGAGCGGCCCTGAGCTGAAGAAACCC |
| | GGCGCCAGCGTGAAAATCAGCTGCAAGACCAGCGGCTACACAT |
| | TCACCGAGTACACCATCAACTGGGTGAAGCAGGCTCCCGGACA |
| | GGGACTGGAGTGGATCGGCGACATCTACCCTGACAACTACAAC |
| | ATCAGATACAACCAAAAGTTCCAGGGCAAGGCCACCATCACCA |
| | GGGACACCAGCTCCTCCACCGCCTACATGGAGCTGAGCAGCCT |
| | GAGGAGCGAGGACACCGCTGTGTACTACTGCGCCAACCACGAC |
| | TTCTTCGTGTTCTGGGGCCAGGGAACCCTGGTGACCGTGAGCA |
| | GCAGTGCTGCTGCCTTTGTCCCGGTATTCTCCCAGCCAAACCG |
| | ACCACGACTCCCGCCCCGCGCCCTCCGACACCCGCTCCCACCA |
| | TCGCCTCTCAACCTCTTAGTCTTCGCCCCGAGGCATGCCGACCC |
| | GCCGCCGGGGTGCTGTTCATACGAGGGGCTTGGACTTCGCTT |
| | GTGATATTTACATTTGGGCTCCGTTGGCGGGTACGTGCGGCGTC |
| | CTTTTGTTGTCACTCGTTATTACTTTGTATTGTAATCACAGGAAT |
| | CGCTCAAAGCGGAGTAGGTTGTTGCATTCCGATTACATGAATA |
| | TGACTCCTCGCCGGCCTGGGCCGACAAGAAAACATTACCAACC |
| | CTATGCCCCCCACGAGACTTCGCTGCGTACAGGTCCCGAGTG |
| | AAGTTTTCCCGAAGCGCAGACGCTCCGGCATATCAGCAAGGAC |
| | AGAATCAGCTGTATAACGAACTGAATTTGGACGCCGCGAGGA |
| | GTATGACGTGCTTGATAAACGCCGGGGAGAGACCCGGAAAT |
| | GGGGGGTAAACCCCGAAGAAAGAATCCCCAAGAAGGACTCTA |
| | CAATGAACTCCAGAAGGATAAGATGGCGGAGGCCTACTCAGA |
| | AATAGGTATGAAGGCGAACGACGACGGGAAAAGGTCACGA |
| | TGGCCTCTACCAAGGGGTTGAGTACGGCAACCAAAGATACGTAC |
| | GATGCACTGCATATGCAGGCCCTGCCTCCCAGATAATAATAAA |
| | ATCGCTATCCATCGAAGATGGATGTGTGTTGGTTTTTTGTGTGT |

TABLE 34-continued rAAV Sequences

| SEQ ID NO: | Description | Sequence |
|---|---|---|
| | | GGAGCAACAAATCTGACTTTGCATGTGCAAACGCCTTCAACAA |
| | | CAGCATTATTCCAGAAGACACCTTCTTCCCCAGCCCAGGTAAG |
| | | GGCAGCTTTGGTGCCTTCGCAGGCTGTTTCCTTGCTTCAGGAAT |
| | | GGCCAGGTTCTGCCCAGAGCTCTGGTCAATGATGTCTAAAACT |
| | | CCTCTGATTGGTGGTCTCGGCCTTATCCATTGCCACCAAAACCC |
| | | TCTTTTTACTAAGAAACAGTGAGCCTTGTTCTGGCAGTCCAGAG |
| | | AATGACACGGGAAAAAAGCAGATGAAGAGAAGGTGGCAGGAG |
| | | AGGGCACGTGGCCCAGCCTCAGTCTCTCCAACTGAGTTCCTGC |
| | | CTGCCTGCCTTTGCTCAGACTGTTTGCCCCTTACTGCTCTTCTAG |
| | | GCCTCATTCTAAGCCCCTTCTCCAAGTTGCCTCTCCTTATTTCTC |
| | | CCTGTCTGCCAAAAAATCTTTCCCAGCTCACTAAGTCAGTCTCA |
| | | CGCAGTCACTCATTAACCCACCAATCACTGATTGTGCCGGCAC |
| | | ATGAATGCACCAGGTGTTGAAGTGGAGGAATTAAAAAGTCAG |
| | | ATGAGGGGTGTGCCCAGAGGAAGCACCATTCTAGTTGGGGGAG |
| | | CCCATCTGTCAGCTGGGAAAAGTCCAAATAACTTCAGATTGGA |
| | | ATGTGTTTTAACTCAGGGTTGAGAAAACAGCTACCTTCAGGAC |
| | | AAAAGTCAGGGAAGGGCTCTCTGAAGAAATGCTACTTGAAGAT |
| | | ACCAGCCCTACCAAGGGCAGGGAGAGGACCCTATAGAGGCCT |
| | | GGGACAGGAGCTCAATGAGAAAGGTAACCACGTGCGGACCGA |
| | | GGCTGCAGCGTCGTCCTCCCTAGGAACCCCTAGTGATGGAGTT |
| | | GGCCACTCCCTCTCTGCGCGCTCGCTCGCTCACTGAGGCCGGGC |
| | | GACCAAAGGTCGCCCGACGCCCGGGCTTTGCCCGGGCGGCCTC |
| | | AGTGAGCGAGCGAGCGCGCAGCTGCCTGCAGG |
| 1386 | CTX-179 | CCTGCAGGCAGCTGCGCGCTCGCTCGCTCACTGAGGCCGCCCG |
| | | GGCGTCGGGCGACCTTTGGTCGCCCGGCCTCAGTGAGCGAGCG |
| | | AGCGCGCAGAGAGGGAGTGGCCAACTCCATCACTAGGGGTTCC |
| | | TGCGGCCGCACGCGTGAGATGTAAGGAGCTGCTGTGACTTGCT |
| | | CAAGGCCTTATATCGAGTAAACGGTAGTGCTGGGGCTTAGACG |
| | | CAGGTGTTCTGATTTATAGTTCAAAACCTCTATCAATGAGAGA |
| | | GCAATCTCCTGGTAATGTGATAGATTTCCCAACTTAATGCCAAC |
| | | ATACCATAAACCTCCCATTCTGCTAATGCCCAGCCTAAGTTGGG |
| | | GAGACCACTCCAGATTCCAAGATGTACAGTTTGCTTTGCTGGG |
| | | CCTTTTTCCCATGCCTGCCTTTACTCTGCCAGAGTTATATTGCTG |
| | | GGGTTTTGAAGAAGATCCTATTAAATAAAAGAATAAGCAGTAT |
| | | TATTAAGTAGCCCTGCATTTCAGGTTTCCTTGAGTGGCAGGCCA |
| | | GGCCTGGCCGTGAACGTTCACTGAAATCATGGCCTCTTGGCCA |
| | | AGATTGATAGCTTGTGCCTGTCCCTGAGTCCCAGTCCATCACGA |
| | | GCAGCTGGTTTCTAAGATGCTATTTCCCGTATAAAGCATGAGA |
| | | CCGTGACTTGCCAGCCCCACAGAGCCCCGCCCTTGTCCATCACT |
| | | GGCATCTGGACTCCAGCCTGGGTTGGGGCAAAGAGGGAAATG |
| | | AGATCATGTCCTAACCCTGATCCTCTTGTCCCACAGATATCCAG |
| | | AACCCTGACCCTGCCGTGTACCAGCTGAGAGACTCTAAATCCA |
| | | GTGACAAGTCTGTCTGCCTATTCACCGATTTTGATTCTCAAACA |
| | | AATGTGTCACAAAGTAAGGATTCTGATGTGTATATCACAGACA |
| | | AAACTGTGCTAGACATGAGGTCTATGGACTTCAGGCTCCGGTG |
| | | CCCGTCAGTGGGCAGAGCGCACATCGCCCACAGTCCCGAGAA |
| | | GTTGGGGGAGGGGTCGGCAATTGAACCGGTGCCTAGAGAAG |
| | | GTGGCGCGGGGTAAACTGGGAAAGTGATGTCGTGTACTGGCTC |
| | | CGCCTTTTTCCCGAGGGTGGGGGAGAACCGTATATAAGTCAG |
| | | TAGTCGCCGTGAACGTTCTTTTTCGCAACGGGTTTGCCGCCAGA |
| | | ACACAGGTAAGTGCCGTGTGTGGTTCCCGCGGGCCTGGCCTCT |
| | | TTACGGGTTATGGCCCTTGCGTGCCTTGAATTACTTCCACTGGC |
| | | TGCAGTACGTGATTCTTGATCCCGAGCTTCGGGTTGGAAGTGG |
| | | GTGGGAGAGTTCGAGGCCTTGCGCTTAAGGAGCCCCTTCGCCT |
| | | CGTGCTTGAGTTGAAGGCCTGGCCTGGGCGCTGGGGCCGCCGCG |
| | | TGCGAATCTGGTGGCACCTTCGCGCCTGTCTCGCTGCTTTCGAT |
| | | AAGTCTCTAGCCATTTAAAATTTTTGATGACCTGCTGCGACGCT |
| | | TTTTTTCTGGCAAGATAGTCTTGTAAATGCGGGCCAAGATCTGC |
| | | ACACTGGTATTTCGGTTTTTGGGGCCGCGGGCGGCGACGGGGC |
| | | CCGTGCGTCCCAGCGCACATGTTCGGCGAGGCGGGGCCTGCGA |
| | | GCGCGGCCACCGAGAATCGGACGGGGGTAGTCTCAAGCTGGCC |
| | | GGCCTGCTCTGGTGCCTGGCCTCGCGCCGCCGTGTATCGCCCCG |
| | | CCCTGGGCGGCAAGGCTGGCCCGGTCGGCACCAGTTGCGTGAG |
| | | CGGAAAGATGGCCGCTTCCCGGCCCTGCTGCAGGGAGCTCAAA |
| | | ATGGAGGACGCGCGCTCGGGAGAGCGGGCGGGTGAGTCACC |
| | | CACACAAAGGAAAAGGGCCTTTCCGTCCTCAGCCGTCGCTTCA |
| | | TGTGACTCCACGGAGTACCGGGCGCCGTCCAGGCACCTCGATT |
| | | AGTTCTCGAGCTTTTGGAGTACGTCGTCTTTAGGTTGGGGGGAG |
| | | GGGTTTTATGCGATGGAGTTTCCCCACACTGAGTGGGTGGAGA |
| | | CTGAAGTTAGGCCAGCTTGGCACTTGATGTAATTCTCCTTGGAA |
| | | TTTGCCCTTTTTGAGTTTGGATCTTGGTTCATTCTCAAGCCTCAG |
| | | ACAGTGGTTCAAAGTTTTTTTCTTCCATTTCAGGTGTCGTGACC |
| | | ACCATGGCGCTTCCGGTGACAGCACTGCTCCTCCCCTTGGCGCT |
| | | GTTGCTCCACGCAGCAAGGCCGGATATCCAGATGACACAAAGC |
| | | CCCAGCAGCCTGTCCGCTAGCCTGGGCGATAGGGTGACCATCA |

TABLE 34-continued rAAV Sequences

| SEQ ID NO: | Description | Sequence |
|---|---|---|
| | | CATGCAGGACCAGCCAGGACATCTCCAACCACCTGAACTGGTA |
| | | CCAGCAGAAGCCTGGAAAGGCCCCCAAACTGCTGATCTACTAC |
| | | ACCAGCAGGCTGGAGAGCGGCGTGCCTAGCAGGTTTTCCGGCA |
| | | GCGGCAGCGGCACCGACTATAGCCTGACCATCAGCTCCCTGCA |
| | | GCCCGAGGACATCGGCACCTACTACTGCCAGCAGGGAAACACA |
| | | CTGCCCCCCACCTTTGGCGGCGGCACAAAGCTGGAGATCAAGG |
| | | GCGGCGGCGGATCCGGCGGCGGAGGCAGCGGAGGAGGAGGAA |
| | | GCCAGGTGCAGCTGGTGCAGTCCGGCCCTGAGCTGAAGAAGCC |
| | | CGGAGCCAGCGTGAAAATTAGCTGCAAGACCTCCGGCTACACA |
| | | TTCACCGAGTACACCATCAACTGGGTGAAGCAGGCTCCCGGCC |
| | | AGGGACTGGAGTGGATCGGCGACATCTACCCCGACAACTACAA |
| | | CATCAGGTACAACCAGAAATTCCAGGGCAAGGCCACCATCACC |
| | | AGGGACACCAGCTCCTCCACCGCCTATATGGAGCTGTCCAGCC |
| | | TGAGAAGCGAGGATACCGCCGTGTACTACTGCGCCAACCACGA |
| | | TTTCTTCGTGTTCTGGGGCCAGGGCACACTGGTCACCGTGAGCA |
| | | GCAGTGCTGCTGCCTTTGTCCCGGTATTTCTCCCAGCCAAACCG |
| | | ACCACGACTCCCGCCCCGCGCCCTCCGACACCCGCTCCCACCA |
| | | TCGCCTCTCAACCTCTTAGTCTTCGCCCCGAGGCATGCCGACCC |
| | | GCCGCCGGGGGTGCTGTTCATACGAGGGGCTTGGACTTCGCTT |
| | | GTGATATTTACATTTGGGCTCCGTTGGCGGGTACGTGCGGCGTC |
| | | CTTTTGTTGTCACTCGTTATTACTTTGTATTGTAATCACAGGAAT |
| | | CGCTCAAAGCGGAGTAGGTTGTTGCATTCCGATTACATGAATA |
| | | TGACTCCTCGCCGGCCTGGGCCGACAAGAAAACATTACCAACC |
| | | CTATGCCCCCCACGAGACTTCGCTGCGTACAGGTCCCGAGTG |
| | | AAGTTTTCCCGAAGCGCAGACGCTCCGGCATATCAGCAAGGAC |
| | | AGAATCAGCTGTATAACGAACTGAATTTGGGACGCCGCGAGGA |
| | | GTATGACGTGCTTGATAAACGCCGGGGAGAGACCCGGAAAT |
| | | GGGGGGTAAACCCCGAAGAAAGAATCCCCAAGAAGGACTCTA |
| | | CAATGAACTCCAGAAGGATAAGATGGCGGAGGCCTACTCAGA |
| | | AATAGGTATGAAGGGCGAACGACGACGGGGAAAAGGTCACGA |
| | | TGGCCTCTACCAAGGGTTGAGTACGGCAACCAAAGATACGTAC |
| | | GATGCACTGCATATGCAGGCCCTGCCTCCCAGATAATAATAAA |
| | | ATCGCTATCCATCGAAGATGGATGTGTGTTGGTTTTTTGTGTGT |
| | | GGAGCAACAAATCTGACTTTGCATGTGCAAACGCCTTCAACAA |
| | | CAGCATTATTCCAGAAGACACCTTCTTCCCCAGCCCAGGTAAG |
| | | GGCAGCTTTGGTGCCTTCGCAGGCTGTTTCCTTGCTTCAGGAAT |
| | | GGCCAGGTTCTGCCCAGAGCTCTGGTCAATGATGTCTAAAACT |
| | | CCTCTGATTGGTGGTCTCGGCCTTATCATTGCCACCAAAACCC |
| | | TCTTTTTACTAAGAAACAGTGAGCCTTGTTCTGGCAGTCCAGAG |
| | | AATGACACGGGAAAAAAGCAGATGAAGAGAAGGTGGCAGGAG |
| | | AGGGCACGTGGCCCAGCCTCAGTCTCTCCAACTGAGTTCCTGC |
| | | CTGCCTGCCTTTGCTCAGACTGTTTGCCCCTTACTGCTCTTCTAG |
| | | GCCTCATTCTAAGCCCCTTCTCCAAGTTGCCTCTCCTTATTTCTC |
| | | CCTGTCTGCCAAAAAATCTTTCCCAGCTCACTAAGTCAGTCTCA |
| | | CGCAGTCACTCATTAACCCACCAATCACTGATTGTGCCGGCAC |
| | | ATGAATGCACCAGGTGTTGAAGTGGAGGAATTAAAAAGTCAG |
| | | ATGAGGGGTGTGCCCAGAGGAAGCACCATTCTAGTTGGGGGAG |
| | | CCCATCTGTCAGCTGGGAAAAGTCCAAATAACTTCAGATTGGA |
| | | ATGTGTTTTAACTCAGGGTTGAGAAAACAGCTACCTTCAGGAC |
| | | AAAAGTCAGGGAAGGGCTCTCTGAAGAAATGCTACTTGAAGAT |
| | | ACCAGCCCTACCAAGGGCAGGGAGAGGACCCTATAGAGGCCT |
| | | GGGACAGGAGCTCAATGAGAAAGGTAACCACGTGCGGACCGA |
| | | GGCTGCAGCGTCGTCCTCCCTAGGAACCCCTAGTGATGGAGTT |
| | | GGCCACTCCCTCTCTGCGCGCTCGCTCGCTCACTGAGGCCGGGC |
| | | GACCAAAGGTCGCCCGACGCCCGGGCTTTGCCCGGGCGGCCTC |
| | | AGTGAGCGAGCGAGCGCGCAGCTGCCTGCAGG |
| 1583 | CTX-139.1 | CCTGCAGGCAGCTGCGCGCTCGCTCGCTCACTGAGGCCGCCCG |
| | | GGCGTCGGGCGACCTTTGGTCGCCCGGCCTCAGTGAGCGAGCG |
| | | AGCGCGCAGAGAGGGAGTGGCCAACTCCATCACTAGGGGTTCC |
| | | TGCGGCCGCACGCGTTGTTTGGTACTTTACAGTTTATTAAATAG |
| | | ATGTTTATATGGAGAAGCTCTCATTTCTTTCTCAGAAGAGCCTG |
| | | GCTAGGAAGGTGGATGAGGCACCATATTCATTTTGCAGGTGAA |
| | | ATTCCTGAGATGTAAGGAGCTGCTGTGACTTGCTCAAGGCCTT |
| | | ATATCGAGTAAACGGTAGTGCTGGGCTTAGACGCAGGTGTTC |
| | | TGATTTATAGTTCAAAACCTCTATCAATGAGAGAGCAATCTCCT |
| | | GGTAATGTGATAGATTTCCCAACTTAATGCCAACATACCATAA |
| | | ACCTCCCATTCTGCTAATGCCCAGCCTAAGTTGGGGAGACCAC |
| | | TCCAGATTCCAAGATGTACAGTTTGCTTTGCTGGGCCTTTTTCC |
| | | CATGCCTGCCTTTACTCTGCCAGAGTTATATTGCTGGGGTTTTG |
| | | AAGAAGATCCTATTAAATAAAAGAATAAGCAGTATTATTAAGT |
| | | AGCCCTGCATTTCAGGTTTCCTTGAGTGGCAGGCCAGGCCTGG |
| | | CCGTGAACGTTCACTGAAATCATGGCCTCTTGGCCAAGATTGA |
| | | TAGCTTGTGCCTGTCCCTGAGTCCCAGTCCATCACGAGCAGCTG |
| | | GTTTCTAAGATGCTATTTCCCGTATAAAGCATGAGACCGTGACT |
| | | TGCCAGCCCCACAGAGCCCCGCCCTTGTCCATCACTGGCATCTG |

TABLE 34-continued rAAV Sequences

SEQ ID NO:Description Sequence

GACTCCAGCCTGGGTTGGGGCAAAGAGGGAAATGAGATCATGT
CCTAACCCTGATCCTCTTGTCCCACAGATATCCAGAACCCTGAC
CCTGCCGTGTACCAGCTGAGAGACTCTAAATCGGCTCCGGTGC
CCGTCAGTGGGCAGAGCGCACATCGCCCACAGTCCCCGAGAAG
TTGGGGGGAGGGGTCGGCAATTGAACCGGTGCCTAGAGAAGG
TGGCGCGGGGTAAACTGGGAAAGTGATGTCGTGTACTGGCTCC
GCCTTTTTCCCGAGGGTGGGGGAGAACCGTATATAAGTGCAGT
AGTCGCCGTGAACGTTCTTTTTCGCAACGGGTTTGCCGCCAGAA
CACAGGTAAGTGCCGTGTGTGGTTCCCGCGGGCCTGGCCTCTTT
ACGGGTTATGGCCCTTGCGTGCCTTGAATTACTTCCACTGGCTG
CAGTACGTGATTCTTGATCCCGAGCTTCGGGTTGGAAGTGGGT
GGGAGAGTTCGAGGCCTTGCGCTTAAGGAGCCCCTTCGCCTCG
TGCTTGAGTTGAGGCCTGGCCTGGGCGCTGGGGCCGCCGCGTG
CGAATCTGGTGGCACCTTCGCGCCTGTCTCGCTGCTTTCGATAA
GTCTCTAGCCATTTAAAATTTTTGATGACCTGCTGCGACGCTTT
TTTTCTGGCAAGATAGTCTTGTAAATGCGGGCCAAGATCTGCA
CACTGGTATTTCGGTTTTTGGGGCCGCGGGCGGCGACGGGGCC
CGTGCGTCCCAGCGCACATGTTCGGCGAGGCGGGGCCTGCGAG
CGCGGCCACCGAGAATCGGACGGGGGTAGTCTCAAGCTGGCCG
GCCTGCTCTGGTGCCTGGCCTCGCGCCGCCGTGTATCGCCCCGC
CCTGGGCGGCAAGGCTGGCCCGGTCGGCACCAGTTGCGTGAGC
GGAAAGATGGCCGCTTCCCGGCCCTGCTGCAGGGAGCTCAAAA
TGGAGGACGCGGCGCTCGGGAGAGCGGGCGGGTGAGTCACCC
ACACAAAGGAAAAGGGCCTTTCCGTCCTCAGCCGTCGCTTCAT
GTGACTCCACGGAGTACCGGGCGCCGTCCAGGCACCTCGATTA
GTTCTCGAGCTTTTGGAGTACGTCGTCTTTAGGTTGGGGGGAGG
GGTTTTATGCGATGGAGTTTCCCCACACTGAGTGGGTGGAGAC
TGAAGTTAGGCCAGCTTGGCACTTGATGTAATTCTCCTTGGAAT
TTGCCCTTTTTGAGTTTGGATCTTGGTTCATTCTCAAGCCTCAG
ACAGTGGTTCAAAGTTTTTTTCTTCCATTTCAGGTGTCGTGACC
ACCATGCTTCTTTTGGTTACGTCTCTGTTGCTTTGCGAACTTCCT
CATCCAGCGTTCTTGCTGATCCCCGATATTCAGATGACTCAGAC
CACCAGTAGCTTGTCTGCCTCACTGGGAGACCGAGTAACAATC
TCCTGCAGGGCAAGTCAAGACATTAGCAAATACCTCAATTGGT
ACCAGCAGAAGCCCGACGGAACGGTAAAACTCCTCATCTATCA
TACGTCAAGGTTGCATTCCGGAGTACCGTCACGATTTTCAGGTT
CTGGGAGCGGAACTGACTATTCCTTGACTATTTCAAACCTCGA
GCAGGAGGACATTGCGACATATTTTTGTCAACAAGGTAATACC
CTCCCTTACACTTTCGGAGGAGGAACCAAACTCGAAATTACCG
GGTCCACCAGTGGCTCTGGGAAGCCTGGCAGTGGAGAAGGTTC
CACTAAAGGCGAGGTGAAGCTCCAGGAGAGCGGCCCCGGTCTC
GTTGCCCCCAGTCAAAGCCTCTCTGTAACGTGCACAGTGAGTG
GTGTATCATTGCCTGATTATGGCGTCTCCTGGATAAGGCAGCCC
CCGCGAAAGGGTCTTGAATGGCTTGGGGTAATATGGGGCTCAG
AGACAACGTATTATAACTCCGCTCTCAAAAGTCGCTTGACGAT
AATAAAAGATAACTCCAAGAGTCAAGTTTTCCTTAAAATGAAC
AGTTTGCAGACTGACGATACCGCTATATATTATTGTGCTAAACA
TTATTACTACGGCGGTAGTTACGCGATGGATTATTGGGGGCAG
GGGACTTCTGTCACAGTCAGTAGTGCTGCTGCCTTTGTCCCGGT
ATTTCTCCCAGCCAAACCGACCACGACTCCCGCCCCGCGCCCTC
CGACACCCGCTCCCACCATCGCCTCTCAACCTCTTAGTCTTCGC
CCCGAGGCATGCCGACCCGCCGCCGGGGGTGCTGTTCATACGA
GGGGCTTGGACTTCGCTTGTGATATTTACATTTGGGCTCCGTTG
GCGGGTACGTGCGGCGTCCTTTTGTTGTCACTCGTTATTACTTT
GTATTGTAATCACAGGAATCGCTCAAAGCGGAGTAGGTTGTTG
CATTCCGATTACATGAATATGACTCCTCGCCGGCCTGGGCCGA
CAAGAAAACATTACCAACCCTATGCCCCCCCACGAGACTTCGC
TGCCGTACAGGTCCCGAGTGAAGTTTTCCCGAAGCGCAGACGCT
CCGGCATATCAGCAAGGACAGAATCAGCTGTATAACGAACTGA
ATTTGGGACGCCGCGAGGAGTATGACGTGCTTGATAAACGCCG
GGGGAGAGACCCGGAAATGGGGGGTAAACCCCGAAGAAAGAA
TCCCCAAGAAGGACTCTACAATGAACTCCAGAAGGATAAGATG
GCGGAGGCCTACTCAGAAATAGGTATGAAGGGCGAACGACGA
CGGGGAAAAGGTCACGATGGCCTCTACCAAGGGTTGAGTACGG
CAACCAAAGATACGTACGATGCACTGCATATGCAGGCCCTGCC
TCCCAGATAATAATAAAATCGCTATCCATCGAAGATGGATGTG
TGTTGGTTTTTTGTGTGTGGAGCAACAAATCTGACTTTGCATGT
GCAAACGCCTTCAACAACAGCATTATTCCAGAAGACACCTTCT
TCCCCAGCCCAGGTAAGGGCAGCTTTGGTGCCTTCGCAGGCTG
TTTCCTTGCTTCAGGAATGGCCAGGTTCTGCCCAGAGCTCTGGT
CAATGATGTCTAAAACTCCTCTGATTGGTGGTCTCGGCCTTATC
CATTGCCACCAAAACCCTCTTTTTACTAAGAAACAGTGAGCCTT
GTTCTGGCAGTCCAGAGAATGACACGGGAAAAAAGCAGATGA
AGAGAAGGTGGCAGGAGAGGGCACGTGGCCCAGCCTCAGTCT
CTCCAACTGAGTTCCTGCCTGCCTGCCTTTGCTCAGACTGTTTG
CCCCTTACTGCTCTTCTAGGCCTCATTCTAAGCCCCTTCTCCAA

TABLE 34-continued rAAV Sequences

| SEQ ID NO: | Description | Sequence |
|---|---|---|
| | | GTTGCCTCTCCTTATTTCTCCCTGTCTGCCAAAAAATCTTTCCCA
GCTCACTAAGTCAGTCTCACGCAGTCACTCATTAACCCACCAAT
CACTGATTGTGCCGGCACATGAATGCACCAGGTGTTGAAGTGG
AGGAATTAAAAAGTCAGATGAGGGGTGTGCCCAGAGGAAGCA
CCATTCTAGTTGGGGGAGCCCATCTGTCAGCTGGGAAAAGTCC
AAATAACTTCAGATTGGAATGTGTTTTAACTCAGGGTTGAGAA
AACAGCTACCTTCAGGACAAAAGTCAGGGAAGGGCTCTCTGAA
GAAATGCTACTTGAAGATACCAGCCCTACCAAGGGCAGGGAG
AGGACCCTATAGAGGCCTGGGACAGGAGCTCAATGAGAAAGG
TAACCACGTGCGGACCGAGGCTGCAGCGTCGTCCTCCCTAGGA
ACCCCTAGTGATGGAGTTGGCCACTCCCTCTCTGCGCGCTCGCT
CGCTCACTGAGGCCGGGCGACCAAAGGTCGCCCGACGCCCGGG
CTTTGCCCGGGCGGCCTCAGTGAGCGAGCGAGCGCGCAGCTGC
CTGCAGG |
| 1584 | CTX-139.2 | CCTGCAGGCAGCTGCGCGCTCGCTCGCTCACTGAGGCCGCCCG
GGCGTCGGGCGACCTTTGGTCGCCCGGCCTCAGTGAGCGAGCG
AGCGCGCAGAGAGGGAGTGGCCAACTCCATCACTAGGGGTTCC
TGCGGCCGCACGCGTgtttggtactttacagtttattaaatagatgtt-
tat
atggagaagctctcatttctttctcagaagagcctggctaggaa
ggtggatgaggcaccatattcattttgcaggtgaaattcctG
AGATGTAAGGAGCTGCTGTGACTTGCTCAAGGCCTTATATCGA
GTAAACGGTAGTGCTGGGGCTTAGACGCAGGTGTTCTGATTTA
TAGTTCAAAACCTCTATCAATGAGAGAGCAATCTCCTGGTAAT
GTGATAGATTTCCCAACTTAATGCCAACATACCATAAACCTCCC
ATTCTGCTAATGCCCAGCCTAAGTTGGGGAGACCACTCCAGAT
TCCAAGATGTACAGTTTGCTTTGCTGGGCCTTTTTCCCATGCCT
GCCTTTACTCTGCCAGAGTTATATTGCTGGGGTTTTGAAGAAGA
TCCTATTAAATAAAAGAATAAGCAGTATTATTAAGTAGCCCTG
CATTTCAGGTTTCCTTGAGTGGCAGGCCAGGCCTGGCCGTGAA
CGTTCACTGAAATCATGGCCTCTTGGCCAAGATTGATAGCTTGT
GCCTGTCCCTGAGTCCCAGTCCATCACGAGCAGCTGGTTTCTAA
GATGCTATTTCCCGTATAAAGCATGAGACCGTGACTTGCCAGC
CCCACAGAGCCCCGCCCTTGTCCATCACTGGCATCTGGACTCCA
GCCTGGGTTGGGGCAAAGAGGGAAATGAGATCATGTCCTAACC
CTGATCCTCTTGTCCCACAGATATCCAGAACCCTGACCCTGCCG
TGTACCAGCTGAGAGACTCTAAATCCAGTGACAAGTCTGTCTG
CCGGCTCCGGTGCCCGTCAGTGGGCAGAGCGCACATCGCCCAC
AGTCCCCGAGAAGTTGGGGGGAGGGGTCGGCAATTGAACCGG
TGCCTAGAGAAGGTGGCGCGGGGTAAACTGGGAAAGTGATGT
CGTGTACTGGCTCCGCCTTTTTCCCGAGGGTGGGGGAGAACCG
TATATAAGTGCAGTAGTCGCCGTGAACGTTCTTTTTCGCAACGG
GTTTGCCGCCAGAACACAGGTAAGTGCCGTGTGTGGTTCCCGC
GGGCCTGGCCTCTTTACGGGTTATGGCCCTTGCGTGCCTTGAAT
TACTTCCACTGGCTGCAGTACGTGATTCTTGATCCCGAGCTTCG
GGTTGGAAGTGGGTGGGAGAGTTCGAGGCCTTGCGCTTAAGGA
GCCCCTTCGCCTCGTGCTTGAGTTGAGGCCTGGCCTGGGCGCTG
GGGCCGCCGCGTGCGAATCTGGTGGCACCTTCGCGCCTGTCTC
GCTGCTTTCGATAAGTCTCTAGCCATTTAAAATTTTTGATGACC
TGCTGCGACGCTTTTTTTCTGGCAAGATAGTCTTGTAAATGCGG
GCCAAGATCTGCACACTGGTATTTCGGTTTTTGGGGCCGCGGG
CGGCGACGGGGCCCGTGCGTCCCAGCGCACATGTTCGGCGAGG
CGGGGCCTGCGAGCGCGGCCACCGAGAATCGGACGGGGGTAG
TCTCAAGCTGGCCGGCCTGCTCTGGTGCCTGGCCTCGCGCCGCC
GTGTATCGCCCCGCCCTGGGCGGCAAGGCTGGCCCGGTCGGCA
CCAGTTGCGTGAGCGGAAAGATGGCCGCTTCCCGGCCCTGCTG
CAGGGAGCTCAAATGGAGGACGCGGCGCTCGGGAGAGCGGG
CGGGTGAGTCACCCACACAAAGGAAAAGGGCCTTTCCGTCCTC
AGCCGTCGCTTCATGTGACTCCACGGAGTACCGGGCGCCGTCC
AGGCACCTCGATTAGTTCTCGAGCTTTTGGAGTACGTCGTCTTT
AGGTTGGGGGAGGGGTTTTATGCGATGGAGTTTCCCCACACT
GAGTGGGTGGAGACTGAAGTTAGGCCAGCTTGGCACTTGATGT
AATTCTCCTTGGAATTTGCCCTTTTTGAGTTTGGATCTTGGTTCA
TTCTCAAGCCTCAGACAGTGGTTCAAAGTTTTTTTCTTCCATTTC
AGGTGTCGTGACCACCATGCTTCTTTTGGTTACGTCTCTGTTGC
TTTGCGAACTTCCTCATCCAGCGTTCTTGCTGATCCCCGATATT
CAGATGACTCAGACCACCAGTAGCTTGTCTGCCTCACTGGGAG
ACCGAGTAACAATCTCCTGCAGGGCAAGTCAAGACATTAGCAA
ATACCTCAATTGGTACCAGCAGAAGCCCGACGGAACGGTAAAA
CTCCTCATCTATCATACGTCAAGGTTGCATTCCGGAGTACCGTC
ACGATTTTCAGGTTCTGGGAGCGGAACTGACTATTCCTTGACTA
TTTCAAACCTCGAGCAGGAGGACATTGCGACATATTTTTGTCA
ACAAGGTAATACCCTCCCTTACACTTTCGGAGGAGGAACCAAA
CTCGAAATTACCGGGTCCACCAGTGGCTCTGGGAAGCCTGGCA
GTGGAGAAGGTTCCACTAAAGGCGAGGTGAAGCTCCAGGAGA |

TABLE 34-continued rAAV Sequences

| SEQ ID NO: | Description | Sequence |
|---|---|---|
| | | GCGGCCCCGGTCTCGTTGCCCCCAGTCAAAGCCTCTCTGTAACG<br>TGCACAGTGAGTGGTGTATCATTGCCTGATTATGGCGTCTCCTG<br>GATAAGGCAGCCCCCGCGAAAGGGTCTTGAATGGCTTGGGGTA<br>ATATGGGGCTCAGAGACAACGTATTATAACTCCGCTCTCAAAA<br>GTCGCTTGACGATAATAAAAGATAACTCCAAGAGTCAAGTTTT<br>CCTTAAAATGAACAGTTTGCAGACTGACGATACCGCTATATAT<br>TATTGTGCTAAACATTATTACTACGGCGGTAGTTACGCGATGG<br>ATTATTGGGGGCAGGGGACTTCTGTCACAGTCAGTAGTGCTGC<br>TGCCTTTGTCCCGGTATTTCTCCCAGCCAAACCGACCACGACTC<br>CCGCCCCGCGCCCTCCGACACCCGCTCCCACCATCGCCTCTCAA<br>CCTCTTAGTCTTCGCCCCGAGGCATGCCGACCCGCCGCCGGGG<br>GTGCTGTTCATACGAGGGGCTTGGACTTCGCTTGTGATATTTAC<br>ATTTGGGCTCCGTTGGCGGGTACGTGCGGCGTCCTTTTGTTGTC<br>ACTCGTTATTACTTTGTATTGTAATCACAGGAATCGCTCAAAGC<br>GGAGTAGGTTGTTGCATTCCGATTACATGAATATGACTCCTCGC<br>CGGCCTGGGCCGACAAGAAAACATTACCAACCCTATGCCCCCC<br>CACGAGACTTCGCTGCGTACAGGTCCCGAGTGAAGTTTTCCCG<br>AAGCGCAGACGCTCCGGCATATCAGCAAGGACAGAATCAGCT<br>GTATAACGAACTGAATTTGGGACGCCGCGAGGAGTATGACGTG<br>CTTGATAAACGCCGGGGAGAGACCCGGAAATGGGGGGTAAA<br>CCCCGAAGAAAGAATCCCCAAGAAGGACTCTACAATGAACTCC<br>AGAAGGATAAGATGGCGGAGGCCTACTCAGAAATAGGTATGA<br>AGGGCGAACGACGACGGGGAAAAGGTCACGATGGCCTCTACC<br>AAGGGTTGAGTACGGCAACCAAAGATACGTACGATGCACTGCA<br>TATGCAGGCCCTGCCTCCCAGATAATAATAAAATCGCTATCCA<br>TCGAAGATGGATGTGTGTTGGTTTTTTGTGTGAAACAAATGTGT<br>CACAAAGTAAGGATTCTGATGTGTATATCACAGACAAAACTGT<br>GCTAGACATGAGGTCTATGGACTTCAAGAGCAACAGTGCTGTG<br>GCCTGGAGCAACAAATCTGACTTTGCATGTGCAAACGCCTTCA<br>ACAACAGCATTATTCCAGAAGACACCTTCTTCCCCAGCCCAGG<br>TAAGGGCAGCTTTGGTGCCTTCGCAGGCTGTTTCCTTGCTTCAG<br>GAATGGCCAGGTTCTGCCCAGAGCTCTGGTCAATGATGTCTAA<br>AACTCCTCTGATTGGTGGTCTCGGCCTTATCCATTGCCACCAAA<br>ACCCTCTTTTTACTAAGAAACAGTGAGCCTTGTTCTGGCAGTCC<br>AGAGAATGACACGGGAAAAAAGCAGATGAAGAGAAGGTGGCA<br>GGAGAGGGCACGTGGCCCAGCCTCAGTCTCTCCAACTGAGTTC<br>CTGCCTGCCTGCCTTTGCTCAGACTGTTTGCCCCTTACTGCTCTT<br>CTAGGCCTCATTCTAAGCCCCTTCTCCAAGTTGCCTCTCCTTATT<br>TCTCCCTGTCTGCCAAAAAATCTTTCCCAGCTCACTAAGTCAGT<br>CTCACGCAGTCACTCATTAACCCACCAATCACTGATTGTGCCGG<br>CACATGAATGCACCAGGTGTTGAAGTGGAGGAATTAAAAAGTC<br>AGATGAGGGGTGTGCCCAGAGGAAGCACCATTCTAGTTGGGGG<br>AGCCCATCTGTCAGCTGGGAAAAGTCCAAATAACTTCAGATTG<br>GAATGTGTTTTAACTCAGGGTTGAGAAAACAGCTACCTTCAGG<br>ACAAAAGTCAGGGAAGGGCTCTCTGAAGAAATGCTACTTGAAG<br>ATACCAGCCCTACCAAGGGCAGGGAGAGGACCCTATAGAGGC<br>CTGGGACAGGAGCTCAATGAGAAAGGTAACCACGTGCGGACC<br>GAGGCTGCAGCGTCGTCCTCCCTAGGAACCCCTAGTGATGGAG<br>TTGGCCACTCCCTCTCTGCGCGCTCGCTCGCTCACTGAGGCCGG<br>GCGACCAAAGGTCGCCCGACGCCCGGGCTTTGCCCGGGCGGCC<br>TCAGTGAGCGAGCGAGCGCGCAGCTGCCTGCAGG |
| 1585 | CTX-139.3 | CCTGCAGGCAGCTGCGCGCTCGCTCGCTCACTGAGGCCGCCCG<br>GGCGTCGGGCGACCTTTGGTCGCCCGGCCTCAGTGAGCGAGCG<br>AGCGCGCAGAGAGGGAGTGGCCAACTCCATCACTAGGGGTTCC<br>TGCGGCCGCACGCGTTGTTTGGTACTTTACAGTTTATTAAATAG<br>ATGTTTATATGGAGAAGCTCTCATTTCTTTCTCAGAAGAGCCTG<br>GCTAGGAAGGTGGATGAGGCACCATATTCATTTTGCAGGTGAA<br>ATTCCTGAGATGTAAGGAGCTGCTGTGACTTGCTCAAGGCCTT<br>ATATCGAGTAAACGGTAGTGCTGGGGCTTAGACGCAGGTGTTC<br>TGATTTATAGTTCAAAACCTCTATCAATGAGAGAGCAATCTCCT<br>GGTAATGTGATAGATTTCCCAACTTAATGCCAACATACCATAA<br>ACCTCCCATTCTGCTAATGCCCAGCCTAAGTTGGGGAGACCAC<br>TCCAGATTCCAAGATGTACAGTTTGCTTTGCTGGGCCTTTTTCC<br>CATGCCTGCCTTTACTCTGCCAGAGTTATATTGCTGGGGTTTTG<br>AAGAAGATCCTATTAAATAAAAGAATAAGCAGTATTATTAAGT<br>AGCCCTGCATTTCAGGTTTCCTTGAGTGGCAGGCCAGGCCTGG<br>CCGTGAACGTTCACTGAAATCATGGCCTCTTGGCCAAGATTGA<br>TAGCTTGTGCCTGTCCCTGAGTCCCAGTCCATCACGAGCAGCTG<br>GTTTCTAAGATGCTATTTCCCGTATAAAGCATGAGACCGTGACT<br>TGCCAGCCCCACAGAGCCCCGCCCTTGTCCATCACTGGCATCTG<br>GACTCCAGCCTGGGTTGGGGCAAAGAGGGAAATGAGATCATGT<br>CCTAACCCTGATCCTCTTGTCCCACAGATATCCAGAACCCTGAC<br>CCTGCCGTGTACCAGCTGAGAGACTCTAAATCCAGTGACAAGT<br>CTGTCTGACTATTCACCGATTTTGATTCTCGGCTCCGGTGCCCG<br>TCAGTGGGCAGAGCGCACATCGCCCACAGTCCCCGAGAAGTTG |

TABLE 34-continued rAAV Sequences

SEQ ID NO:Description Sequence

GGGGGAGGGGTCGGCAATTGAACCGGTGCCTAGAGAAGGTGG
CGCGGGGTAAACTGGGAAAGTGATGTCGTGTACTGGCTCCGCC
TTTTTCCCGAGGGTGGGGGAGAACCGTATATAAGTGCAGTAGT
CGCCGTGAACGTTCTTTTTCGCAACGGGTTTGCCGCCAGAACAC
AGGTAAGTGCCGTGTGTGGTTCCCGCGGGCCTGGCCTCTTTACG
GGTTATGGCCCTTGCGTGCCTTGAATTACTTCCACTGGCTGCAG
TACGTGATTCTTGATCCCGAGCTTCGGGTTGGAAGTGGGTGGG
AGAGTTCGAGGCCTTGCGCTTAAGGAGCCCCTTCGCCTCGTGCT
TGAGTTGAGGCCTGGCCTGGGCGCTGGGGCCGCCGCGTGCGAA
TCTGGTGGCACCTTCGCGCCTGTCTCGCTGCTTTCGATAAGTCT
CTAGCCATTTAAAATTTTTGATGACCTGCTGCGACGCTTTTTTT
CTGGCAAGATAGTCTTGTAAATGCGGGCCAAGATCTGCACACT
GGTATTTCGGTTTTTGGGGCCGCGGGCGGCGACGGGGCCCGTG
CGTCCCAGCGCACATGTTCGGCGAGGCGGGGCCTGCGAGCGCG
GCCACCGAGAATCGGACGGGGGTAGTCTCAAGCTGGCCGGCCT
GCTCTGGTGCCTGGCCTCGCGCCGCCGTGTATCGCCCCGCCCTG
GGCGGCAAGGCTGGCCCGGTCGGCACCAGTTGCGTGAGCGGA
AAGATGGCCGCTTCCCGGCCCTGCTGCAGGGAGCTCAAAATGG
AGGACGCGGCGCTCGGGAGAGCGGGCGGGTGAGTCACCCACA
CAAAGGAAAAGGGCCTTTCCGTCCTCAGCCGTCGCTTCATGTG
ACTCCACGGAGTACCGGGCGCCGTCCAGGCACCTCGATTAGTT
CTCGAGCTTTTGGAGTACGTCGTCTTTAGGTTGGGGGGAGGGG
TTTTATGCGATGGAGTTTCCCCACACTGAGTGGGTGGAGACTG
AAGTTAGGCCAGCTTGGCACTTGATGTAATTCTCCTTGGAATTT
GCCCTTTTTGAGTTTGGATCTTGGTTCATTCTCAAGCCTCAGAC
AGTGGTTCAAAGTTTTTTTCTTCCATTTCAGGTGTCGTGACCAC
CATGCTTCTTTTGGTTACGTCTCTGTTGCTTTGCGAACTTCCTCA
TCCAGCGTTCTTGCTGATCCCCGATATTCAGATGACTCAGACCA
CCAGTAGCTTGTCTGCCTCACTGGGAGACCGAGTAACAATCTC
CTGCAGGGCAAGTCAAGACATTAGCAAATACCTCAATTGGTAC
CAGCAGAAGCCCGACGGAACGGTAAAACTCCTCATCTATCATA
CGTCAAGGTTGCATTCCGGAGTACCGTCACGATTTTCAGGTTCT
GGGAGCGGAACTGACTATTCCTTGACTATTTCAAACCTCGAGC
AGGAGGACATTGCGACATATTTTTGTCAACAAGGTAATACCCT
CCCTTACACTTTCGGAGGAGGAACCAAACTCGAAATTACCGGG
TCCACCAGTGGCTCTGGGAAGCCTGGCAGTGGAGAAGGTTCCA
CTAAAGGCGAGGTGAAGCTCCAGGAGAGCGGCCCCGGTCTCGT
TGCCCCCAGTCAAAGCCTCTCTGTAACGTGCACAGTGAGTGGT
GTATCATTGCCTGATTATGGCGTCTCCTGGATAAGGCAGCCCCC
GCGAAAGGGTCTTGAATGGCTTGGGGTAATATGGGGCTCAGAG
ACAACGTATTATAACTCCGCTCTCAAAAGTCGCTTGACGATAA
TAAAAGATAACTCCAAGAGTCAAGTTTTCCTTAAAATGAACAG
TTTGCAGACTGACGATACCGCTATATATTATTGTGCTAAACATT
ATTACTACGGCGGTAGTTACGCGATGGATTATTGGGGCAGGG
GACTTCTGTCACAGTCAGTAGTGCTGCTGCCTTTGTCCCGGTAT
TTCTCCCAGCCAAACCGACCACGACTCCCGCCCCGCGCCCTCC
GACACCCGCTCCCACCATCGCCTCTCAACCTCTTAGTCTTCGCC
CCGAGGCATGCCGACCCGCCGCCGGGGGTGCTGTTCATACGAG
GGGCTTGGACTTCGCTTGTGATATTTACATTTGGGCTCCGTTGG
CGGGTACGTGCGGCGTCCTTTTGTTGTCACTCGTTATTACTTTG
TATTGTAATCACAGGAATCGCTCAAAGCGGAGTAGGTTGTTGC
ATTCCGATTACATGAATATGACTCCTCGCCGGCCTGGGCCGAC
AAGAAAACATTACCAACCCTATGCCCCCCACGAGACTTCGCT
GCGTACAGGTCCCGAGTGAAGTTTTCCCGAAGCGCAGACGCTC
CGGCATATCAGCAAGGACAGAATCAGCTGTATAACGAACTGAA
TTTGGACGCCGCGAGGAGTATGACGTGCTTGATAAACGCCGG
GGGAGAGACCCGGAAATGGGGGGTAAACCCCGAAGAAAGAAT
CCCCAAGAAGGACTCTACAATGAACTCCAGAAGGATAAGATG
GCGGAGGCCTACTCAGAAATAGGTATGAAGGGCGAACGACGA
CGGGGAAAAGGTCACGATGGCCTCTACCAAGGGTTGAGTACGG
CAACCAAAGATACGTACGATGCACTGCATATGCAGGCCCTGCC
TCCCAGATAATAAAAATCGCTATCCATCGAAGATGGATGTG
TGTTGGTTTTTTGTGTGATTCACCGATTTTGATTCTCAAACAAAT
GTGTCACAAAGTAAGGATTCTGATGTGTATATCACAGACAAAA
CTGTGCTAGACATGAGGTCTATGGACTTCAAGAGCAACAGTGC
TGTGGCCTGGAGCAACAAATCTGACTTTGCATGTGCAAACGCC
TTCAACAACAGCATTATTCCAGAAGACACCTTCTTCCCCAGCCC
AGGTAAGGGCAGCTTTGGTGCCTTCGCAGGCTGTTTCCTTGCTT
CAGGAATGGCCAGGTTCTGCCCAGAGCTCTGGTCAATGATGTC
TAAAACTCCTCTGATTGGTGGTCTCGGCCTTATCCATTGCCACC
AAAACCCTCTTTTTACTAAGAAACAGTGAGCCTTGTTCTGGCAG
TCCAGAGAATGACACGGGAAAAAAGCAGATGAAGAGAAGGTG
GCAGGAGAGGGCACGTGCCCAGCCTCAGTCTCTCCAACTGAG
TTCCTGCCTGCCTGCCTTTGCTCAGACTGTTTGCCCCTTACTGCT
CTTCTAGGCCTCATTCTAAGCCCCTTCTCCAAGTTGCCTCTCCTT
ATTTCTCCCTGTCTGCCAAAAAATCTTTCCCAGCTCACTAAGTC

TABLE 34-continued rAAV Sequences

| SEQ ID NO: | Description | Sequence |
|---|---|---|
| | | AGTCTCACGCAGTCACTCATTAACCCACCAATCACTGATTGTGC |
| | | CGGCACATGAATGCACCAGGTGTTGAAGTGGAGGAATTAAAA |
| | | AGTCAGATGAGGGGTGTGCCCAGAGGAAGCACCATTCTAGTTG |
| | | GGGGAGCCCATCTGTCAGCTGGGAAAAGTCCAAATAACTTCAG |
| | | ATTGGAATGTGTTTTAACTCAGGGTTGAGAAAACAGCTACCTT |
| | | CAGGACAAAAGTCAGGGAAGGGCTCTCTGAAGAAATGCTACTT |
| | | GAAGATACCAGCCCTACCAAGGGCAGGGAGAGGACCCTATAG |
| | | AGGCCTGGGACAGGAGCTCAATGAGAAAGGTAACCACGTGCG |
| | | GACCGAGGCTGCAGCGTCGTCCTCCCTAGGAACCCCTAGTGAT |
| | | GGAGTTGGCCACTCCCTCTCTGCGCGCTCGCTCGCTCACTGAGG |
| | | CCGGGCGACCAAAGGTCGCCCGACGCCCGGGCTTTGCCCGGGC |
| | | GGCCTCAGTGAGCGAGCGAGCGCGCAGCTGCCTGCAGG |

TABLE 35

Donor Template Nucleotide Sequences-Left Homology Arm to Right Homology Arm

| SEQ ID NO: | Description | Sequence |
|---|---|---|
| 1387 | LHA to RHA of CTX-131 | GAAGCCCAGAGCAGGGCCTTAGGGAAGCGGGACCCTGCTCTG
GGCGGAGGAATATGTCCCAGATAGCACTGGGGACTCTTTAAGG
AAAGAAGGATGGAGAAAGAGAAAGGGAGTAGAGGCGGCCAC
GACCTGGTGAACACCTAGGACGCACCATTCTCACAAAGGGAGT
TTTCCACACGGACACCCCCTCCTCACCACAGCCCTGCCAGGA
CGGGGCTGGCTACTGGCCTTATCTCACAGGTAAAACTGACGCA
CGGAGGAACAATATAAATTGGGGACTAGAAAGGTGAAGAGCC
AAAGTTAGAACTCAGGACCAACTTATTCTGATTTTGTTTTTCCA
AACTGCTTCTCCTCTTGGGAAGTGTAAGGAAGCTGCAGCACCA
GGATCAGTGAAACGCACCAGACGGCCGCGTCAGAGCAGCTCA
GGTTCTGGGAGAGGGTAGCGCAGGGTGGCCACTGAGAACCGG
GCAGGTCACGCATCCCCCCCTTCCCTCCCACCCCCTGCCAAGCT
CTCCCTCCCAGGATCCTCTCTGGCTCCATCGTAAGCAAACCTTA
GAGGTTCTGGCAAGGAGAGAGATGGCTCCAGGAAATGGGGGT
GTGTCACCAGATAAGGAATCTGCCTAACAGGAGGTGGGGGTTA
GACCCAATATCAGGAGACTAGGAAGGAGGAGGCCTAAGGATG
GGGCTTTTCTGTCACCAGCCACTAGTGGCCGCCAGTGTGATGG
ATATCTGCAGAATTCGCCCTTATGGGGATCCGAACAGAGAGAC
AGCAGAATATGGGCCAAACAGGATATCTGTGGTAAGCAGTTCC
TGCCCCGGCTCAGGGCCAAGAACAGTTGGAACAGCAGAATATG
GGCCAAACAGGATATCTGTGGTAAGCAGTTCCTGCCCCGGCTC
AGGGCCAAGAACAGATGGTCCCCAGATGCGGTCCCGCCCTCAG
CAGTTTCTAGAGAACCATCAGATGTTTCCAGGGTGCCCCAAGG
ACCTGAAATGACCCTGTGCCTTATTTGAACTAACCAATCAGTTC
GCTTCTCGCTTCTGTTCGCGCGCTTCTGCTCCCCGAGCTCTATAT
AAGCAGAGCTCGTTTAGTGAACCGTCAGATCGCTGGAGACGC
CATCCACGCTGTTTTGACCTCCATAGAAGACACCGACTCTAGA
GGGACCATGCTTCTTTTGGTTACGTCTCTGTTGCTTTGCGAACT
TCCTCATCCAGCGTTCTTGCTGATCCCCGATATTCAGATGACTC
AGACCACCAGTAGCTTGTCTGCCTCACTGGGAGACCGAGTAAC
AATCTCCTGCAGGGCAAGTCAAGACATTAGCAAATACCTCAAT
TGGTACCAGCAGAAGCCCGACGGAACGGTAAAACTCCTCATCT
ATCATACGTCAAGGTTGCATTCCGGAGTACCGTCACGATTTTCA
GGTTCTGGGAGCGGAACTGACTATTCCTTGACTATTTCAAACCT
CGAGCAGGAGGACATTGCGACATATTTTTGTCAACAAGGTAAT
ACCCTCCCTTACACTTTCGGAGGAGGAACCAAACTCGAAATTA
CCGGGTCCACCAGTGGCTCTGGGAAGCCTGGCAGTGGAGAAGG
TTCCACTAAAGGCGAGGTGAAGCTCCAGGAGAGCGGCCCCGGT
CTCGTTGCCCCCAGTCAAAGCCTCTCTGTAACGTGCACAGTGA
GTGGTGTATCATTGCCTGATTATGGCGTCTCCTGGATAAGGCAG
CCCCCGCGAAAGGGTCTTGAATGGCTTGGGGTAATATGGGGCT
CAGAGACAACGTATTATAACTCCGCTCTCAAAAGTCGCTTGAC
GATAATAAAGATAACTCCAAGAGTCAAGTTTTCCTTAAAATG
AACAGTTTGCAGACTGACGATACCGCTATATATTATTGTGCTAA
ACATTATTACTACGGCGGTAGTTACGCGATGGATTATTGGGGG
CAGGGGACTTCTGTCACAGTCAGTAGTGCTGCTGCCTTTGTCCC
GGTATTTCTCCCAGCCAAACCGACCACGACTCCCGCCCCGCGC
CCTCCGACACCCGCTCCCACCATCGCCTCTCAACCTCTTAGTCT
TCGCCCCGAGGCATGCCGACCCGCCGCCGGGGGTGCTGTTCAT
ACGAGGGGCTTGGACTTCGCTTGTGATATTTACATTTGGGCTCC
GTTGGCGGGTACGTGCGGCGTCCTTTTGTTGTCACTCGTTATTA
CTTTGTATTGTAATACACAGGAATCGCTCAAAGCGGAGTAGGTT
GTTGCATTCCGATTACATGAATATGACTCCTCGCCGGCCTGGGC |

TABLE 35-continued

Donor Template Nucleotide Sequences-Left Homology Arm to Right Homology Arm

| SEQ ID NO: | Description | Sequence |
| --- | --- | --- |
| | | CGACAAGAAAACATTACCAACCCTATGCCCCCCCACGAGACTT<br>CGCTGCGTACAGGTCCCGAGTGAAGTTTTCCCGAAGCGCAGAC<br>GCTCCGGCATATCAGCAAGGACAGAATCAGCTGTATAACGAAC<br>TGAATTTGGGACGCCGCGAGGAGTATGACGTGCTTGATAAACG<br>CCGGGGGAGAGACCCGGAAATGGGGGGTAAACCCCGAAGAAA<br>GAATCCCCAAGAAGGACTCTACAATGAACTCCAGAAGGATAA<br>GATGGCGGAGGCCTACTCAGAAATAGGTATGAAGGGCGAACG<br>ACGACGGGGAAAAGGTCACGATGGCCTCTACCAAGGGTTGAGT<br>ACGGCAACCAAAGATACGTACGATGCACTGCATATGCAGGCCC<br>TGCCTCCCAGAGGAAGCGGAGCTACTAACTTCAGCCTGCTGAA<br>GCAGGCTGGAGACGTGGAGGAGAACCCTGGACCTATGGTGAG<br>CAAGGGCGAGGAGCTGTTCACCGGGGTGGTGCCCATCCTGGTC<br>GAGCTGGACGGCGACGTAAACGGCCACAAGTTCAGCGTGTCCG<br>GCGAGGGCGAGGGCGATGCCACCTACGGCAAGCTGACCCTGA<br>AGTTCATCTGCACCACCGGCAAGCTGCCCGTGCCCTGGCCCAC<br>CCTCGTGACCACCCTGACCTACGGCGTGCAGTGCTTCAGCCGCT<br>ACCCCGACCACATGAAGCAGCACGACTTCTTCAAGTCCGCCAT<br>GCCCGAAGGCTACGTCCAGGAGCGCACCATCTTCTTCAAGGAC<br>GACGGCAACTACAAGACCCGCGCCGAGGTGAAGTTCGAGGGC<br>GACACCCTGGTGAACCGCATCGAGCTGAAGGGCATCGACTTCA<br>AGGAGGACGGCAACATCCTGGGGCACAAGCTGGAGTACAACT<br>ACAACAGCCACAACGTCTATATCATGGCCGACAAGCAGAAGA<br>ACGGCATCAAGGTGAACTTCAAGATCCGCCACAACATCGAGGA<br>CGGCAGCGTGCAGCTCGCCGACCACTACCAGCAGAACACCCCC<br>ATCGGCGACGGCCCCGTGCTGCTGCCCGACAACCACTACCTGA<br>GCACCCAGTCCGCCCTGAGCAAAGACCCCAACGAGAAGCGCG<br>ATCACATGGTCCTGCTGGAGTTCGTGACCGCCGCCGGGATCAC<br>TCTCGGCATGGACGAGCTGTACAAGTAATAATAAAATAAAATC<br>GCTATCCATCGAAGATGGATGTGTGTTGGTTTTTTGTGTGACTG<br>TGGGGTGGAGGGGACAGATAAAAGTACCCAGAACCAGAGCCA<br>CATTAACCGGCCCTGGGAATATAAGGTGGTCCCAGCTCGGGGA<br>CACAGGATCCCTGGAGGCAGCAAACATGCTGTCCTGAAGTGGA<br>CATAGGGGCCCGGGTTGGAGGAAGAAGACTAGCTGAGCTCTCG<br>GACCCCTGGAAGATGCCATGACAGGGGGCTGGAAGAGCTAGC<br>ACAGACTAGAGAGGTAAGGGGGGTAGGGGAGCTGCCCAAATG<br>AAAGGAGTGAGAGGTGACCCGAATCCACAGGAGAACGGGGTG<br>TCCAGGCAAAGAAAGCAAGAGGATGGAGAGGTGGCTAAAGCC<br>AGGGAGACGGGGTACTTTGGGGTTGTCCAGAAAAACGGTGATG<br>ATGCAGGCCTACAAGAAGGGGAGGCGGGACGCAAGGGAGACA<br>TCCGTCGGAGAAGGCCATCCTAAGAAACGAGAGATGGCACAG<br>GCCCCAGAAGGAGAAGGAAAAGGGAACCCAGCGAGTGAAGAC<br>GGCATGGGGTTGGGTGAGGGAGGAGAGATGCCCGGAGAGGAC<br>CCAGACACGGGGAGGATCCGCTCAGAGGACATCACGTGGTGC<br>AGCGCCGAGAAGGAAGTGCTCCGGAAAGAGCATCCTTGGGCA<br>GCAACACAGCAGAGAGCAAGGGGAAGAGGGAGTGGAGGAAG<br>ACGGAACCTGAAGGAGGCGGC |
| 1388 | LHA to RHA of CTX-133 | GAAGATCCTATTAAATAAAAGAATAAGCAGTATTATTAAGTAG<br>CCCTGCATTTCAGGTTTCCTTGAGTGGCAGGCCAGGCCTGGCCG<br>TGAACGTTCACTGAAATCATGGCCTCTTGGCCAAGATTGATAG<br>CTTGTGCCTGTCCCTGAGTCCCAGTCCATCACGAGCAGCTGGTT<br>TCTAAGATGCTATTTCCCGTATAAAGCATGAGACCGTGACTTGC<br>CAGCCCCACAGAGCCCCGCCCTTGTCCATCACTGGCATCTGGA<br>CTCCAGCCTGGGTTGGGGCAAAGAGGGAAATGAGATCATGTCC<br>TAACCCTGATCCTCTTGTCCCACAGATATCCAGAACCCTGACCC<br>TGCCGTGTACCAGCTGAGAGACTCTAAATCCAGTGACAAGTCT<br>GTCTGCCTATTCACCGATTTTGATTCTCAAACAAATGTGTCACA<br>AAGTAAGGATTCTGATGTGTATATCACAGACAAAACTGTGCTA<br>GACATGAGGTCTATGGACTTCAGGCTCCGGTGCCCGTCAGTGG<br>GCAGAGCGCACATCGCCCACAGTCCCCGAGAAGTTGGGGGGA<br>GGGGTCGGCAATTGAACCGGTGCCTAGAGAAGGTGGCGCGGG<br>GTAAACTGGGAAAGTGATGTCGTGTACTGGCTCCGCCTTTTTCC<br>CGAGGGTGGGGAGAACCGTATATAAGTGCAGTAGTCGCCGTG<br>AACGTTCTTTTTCGCAACGGGTTTGCCGCCAGAACACAGGTAA<br>GTGCCGTGTGTGGTTCCCGCGGGCCTGGCCTCTTTACGGGTTAT<br>GGCCCTTGCGTGCCTTGAATTACTTCCACTGGCTGCAGTACGTG<br>ATTCTTGATCCCGAGCTTCGGGTTGGAAGTGGGTGGGAGAGTT<br>CGAGGCCTTGCGCTTAAGGAGCCCCTTCGCCTCGTGCTTGAGTT<br>GAGGGCCTGGCCTGGGCGCTGGGGCCGCCGCGTGCGAATCTGGT<br>GGCACCTTCGCGCCTGTCTCGCTGCTTTCGATAAGTCTCTAGCC<br>ATTTAAAATTTTTGATGACCTGCTGCGACGCTTTTTTTCTGGCA<br>AGATAGTCTTGTAAATGCGGGCCAAGATCTGCACACTGGTATT<br>TCGGTTTTTGGGGCCGCGGGCGGCGACGGGGCCCGTGCGTCCC<br>AGCGCACATGTTCGGCGAGGCGGGGCCTGCGAGCGCGGCCACC<br>GAGAATCGGACGGGGGTAGTCTCAAGCTGGCCGGCCTGCTCTG |

TABLE 35-continued

Donor Template Nucleotide Sequences-Left Homology Arm to Right Homology Arm

| SEQ ID NO: | Description | Sequence |
|---|---|---|
| | | GTGCCTGGCCTCGCGCCGCCGTGTATCGCCCCGCCCTGGGCGG
CAAGGCTGGCCCGGTCGGCACCAGTTGCGTGAGCGGAAAGATG
GCCGCTTCCCGGCCCTGCTGCAGGGAGCTCAAAATGGAGGACG
CGGCGCTCGGGAGAGCGGGCGGGTGAGTCACCCACACAAAGG
AAAAGGGCCTTTCCGTCCTCAGCCGTCGCTTCATGTGACTCCAC
GGAGTACCGGGCGCCGTCCAGGCACCTCGATTAGTTCTCGAGC
TTTTGGAGTACGTCGTCTTTAGGTTGGGGGGAGGGGTTTTATGC
GATGGAGTTTCCCCACACTGAGTGGGTGGAGACTGAAGTTAGG
CCAGCTTGGCACTTGATGTAATTCTCCTTGGAATTTGCCCTTTTT
GAGTTTGGATCTTGGTTCATTCTCAAGCCTCAGACAGTGGTTCA
AAGTTTTTTTCTTCCATTTCAGGTGTCGTGACCACCATGCTTCTT
TTGGTTACGTCTCTGTTGCTTTGCGAACTTCCTCATCCAGCGTTC
TTGCTGATCCCCGATATTCAGATGACTCAGACCACCAGTAGCTT
GTCTGCCTCACTGGGAGACCGAGTAACAATCTCCTGCAGGGCA
AGTCAAGACATTAGCAAATACCTCAATTGGTACCAGCAGAAGC
CCGACGGAACGGTAAAACTCCTCATCTATCATACGTCAAGGTT
GCATTCCGGAGTACCGTCACGATTTTCAGGTTCTGGGAGCGGA
ACTGACTATTCCTTGACTATTTCAAACCTCGAGCAGGAGGACA
TTGCGACATATTTTTGTCAACAAGGTAATACCCTCCCTTACACT
TTCGGAGGAGGAACCAAACTCGAAATTACCGGGTCCACCAGTG
GCTCTGGGAAGCCTGGCAGTGGAGAAGGTTCCACTAAAGGCGA
GGTGAAGCTCCAGGAGAGCGGCCCCGGTCTCGTTGCCCCCAGT
CAAAGCCTCTCTGTAACGTGCACAGTGAGTGGTGTATCATTGC
CTGATTATGGCGTCTCCTGGATAAGGCAGCCCCCGCGAAAGGG
TCTTGAATGGCTTGGGGTAATATGGGGCTCAGAGACAACGTAT
TATAACTCCGCTCTCAAAAGTCGCTTGACGATAATAAAAGATA
ACTCCAAGAGTCAAGTTTTCCTTAAAATGAACAGTTTGCAGAC
TGACGATACCGCTATATATTATTGTGCTAAACATTATTACTACG
GCGGTAGTTACGCGATGGATTATTGGGGGCAGGGGACTTCTGT
CACAGTCAGTAGTGCTGCTGCCTTTGTCCCGGTATTTCTCCCAG
CCAAACCGACCACGACTCCCGCCCCGCGCCCTCCGACACCCGC
TCCCACCATCGCCTCTCAACCTCTTAGTCTTCGCCCCGAGGCAT
GCCGACCCGCCGCCGGGGGTGCTGTTCATACGAGGGGCTTGGA
CTTCGCTTGTGATATTTACATTTGGGCTCCGTTGGCGGGTACGT
GCGGCGTCCTTTTGTTGTCACTCGTTATTACTTTGTATTGTAATC
ACAGGAATCGCTCAAAGCGGAGTAGGTTGTTGCATTCCGATTA
CATGAATATGACTCCTCGCCGGCCTGGGCCGACAAGAAAACAT
TACCAACCCTATGCCCCCCCACGAGACTTCGCTGCGTACAGGT
CCCGAGTGAAGTTTTCCCGAAGCGCAGACGCTCCGGCATATCA
GCAAGGACAGAATCAGCTGTATAACGAACTGAATTTGGGACGC
CGCGAGGAGTATGACGTGCTTGATAAACGCCGGGGGAGAGAC
CCGGAAATGGGGGGTAAACCCCGAAGAAAGAATCCCCAAGAA
GGACTCTACAATGAACTCCAGAAGGATAAGATGGCGGAGGCCT
ACTCAGAAATAGGTATGAAGGGCGAACGACGACGGGGAAAAG
GTCACGATGGCCTCTACCAAGGGTTGAGTACGGCAACCAAAGA
TACGTACGATGCACTGCATATGCAGGCCCTGCCTCCCAGAGGA
AGCGGAGCTACTAACTTCAGCCTGCTGAAGCAGGCTGGAGACG
TGGAGGAGAACCCTGGACCTATGGTGAGCAAGGGCGAGGAGC
TGTTCACCGGGGTGGTGCCCATCCTGGTCGAGCTGGACGGCGA
CGTAAACGGCCACAAGTTCAGCGTGTCCGGCGAGGGCGAGGG
CGATGCCACCTACGGCAAGCTGACCCTGAAGTTCATCTGCACC
ACCGGCAAGCTGCCCGTGCCCTGGCCCACCCTCGTGACCACCC
TGACCTACGGCGTGCAGTGCTTCAGCCGCTACCCCGACCACAT
GAAGCAGCACGACTTCTTCAAGTCCGCCATGCCCGAAGGCTAC
GTCCAGGAGCGCACCATCTTCTTCAAGGACGACGGCAACTACA
AGACCCGCGCCGAGGTGAAGTTCGAGGGCGACACCCTGGTGA
ACCGCATCGAGCTGAAGGGCATCGACTTCAAGGAGGACGGCA
ACATCCTGGGGCACAAGCTGGAGTACAACTACAACAGCCACAA
CGTCTATATCATGGCCGACAAGCAGAAGAACGGCATCAAGGTG
AACTTCAAGATCCGCCACAACATCGAGGACGGCAGCGTGCAGC
TCGCCGACCACTACCAGCAGAACACCCCCATCGGCGACGGCCC
CGTGCTGCTGCCCGACAACCACTACCTGAGCACCCAGTCCGCC
CTGAGCAAAGACCCCAACGAGAAGCGCGATCACATGGTCCTGC
TGGAGTTCGTGACCGCCGCCGGGATCACTCTCGGCATGGACGA
GCTGTACAAGTAATAATAAAATAAAATCGCTATCCATCGAAGA
TGGATGTGTGTTGGTTTTTTGTGTGTGGAGCAACAAATCTGACT
TTGCATGTGCAAACGCCTTCAACAACAGCATTATTCCAGAAGA
CACCTTCTTCCCCAGCCCAGGTAAGGGCAGCTTTGGTGCCTTCG
CAGGCTGTTTCCTTGCTTCAGGAATGGCCAGGTTCTGCCCAGAG
CTCTGGTCAATGATGTCTAAAACTCCTCTGATTGGTGGTCTCGG
CCTTATCCATTGCCACCAAAACCCTCTTTTTACTAAGAAACAGT
GAGCCTTGTTCTGCAGTCCAGAGAATGACACGGGAAAAAAGC
AGATGAAGAGAAGGTGGCAGGAGAGGGCACGTGGCCCAGCCT
CAGTCTCTCCAACTGAGTTCCTGCCTGCCTGCCTTTGCTCAGAC
TGTTTGCCCCTTACTGCTCTTCTAGGCCTCATTCTAAGCCCCTTC |

US 10,729,725 B2

TABLE 35-continued

Donor Template Nucleotide Sequences-Left Homology Arm to Right Homology Arm

| SEQ ID NO: | Description | Sequence |
|---|---|---|
| | | TCCAAGTTGCCTCTCCTTATTTCTCCCTGTCTGCCAAAAAATCTT<br>TCCCAGCTCACTAAGTCAGTCTCACGCAGTCACTCATTAACCC |
| 1389 | LHA to RHA of<br>CTX-135 | TTTTGTAAAGAATATAGGTAAAAAGTGGCATTTTTTCTTTGGAT<br>TTAATTCTTATGGATTTAAGTCAACATGTATTTTCAAGCCAACA<br>AGTTTTGTTAATAAGATGGCTGCACCCTGCTGCTCCATGCCAGA<br>TCCACCACACAGAAAGCAAATGTTCAGTGCATCTCCCTCTTCCT<br>GTCAGAGCTTATAGAGGAAGGAAGACCCCGCAATGTGGAGGC<br>ATATTGTATTACAATTACTTTTAATGGCAAAAACTGCAGTTACT<br>TTTGTGCCAACCTACTACATGGTCTGGACAGCTAAATGTCATGT<br>ATTTTTCATGGCCCCTCCAGGTATTGTCAGAGTCCTCTTGTTTG<br>GCCTTCTAGGAAGGCTGTGGGACCCAGCTTTCTTCAACCAGTCC<br>AGGTGGAGGCCTCTGCCTTGAACGTTTCCAAGTGAGGTAAAAC<br>CCGCAGGCCCAGAGGCCTCTCTACTTCCTGTGTGGGGTTCAGA<br>AACCCTCCTCCCCTCCCAGCCTCAGGTGCCTGCTTCAGAAAATG<br>GTGAGTCTCTCTCTTATAAAGCCCTCCTTTTTCATCCTAGCATTG<br>GGAACAATGGCCCCAGGGTCCTTATCTCTAGCAGATGTTTTGA<br>AAAAGTCATCTGTTTGCTTTTTTTCCAGAAGTAGTAAGTCTGC<br>TGGCCTCCGCCATCTTAGTAAAGTAACAGTCCCATGAAACAAA<br>GATGCTTCTTTTGGTTACGTCTCTGTTGCTTTGCGAACTTCCTCA<br>TCCAGCGTTCTTGCTGATCCCCGATATTCAGATGACTCAGACCA<br>CCAGTAGCTTGTCTGCCTCACTGGGAGACCGAGTAACAATCTC<br>CTGCAGGGCAAGTCAAGACATTAGCAAATACCTCAATTGGTAC<br>CAGCAGAAGCCCGACGGAACGGTAAAACTCCTCATCTATCATA<br>CGTCAAGGTTGCATTCCGGAGTACCGTCACGATTTTCAGGTTCT<br>GGGAGCGGAACTGACTATTCCTTGACTATTTCAAACCTCGAGC<br>AGGAGGACATTGCGACATATTTTTGTCAACAAGGTAATACCCT<br>CCCTTACACTTTCGGAGGAGGAACCAAACTCGAAATTACCGGG<br>TCCACCAGTGGCTCTGGGAAGCCTGGCAGTGGAGAAGGTTCCA<br>CTAAAGGCGAGGTGAAGCTCCAGGAGAGCGGCCCCGGTCTCGT<br>TGCCCCCAGTCAAAGCCTCTCTGTAACGTGCACAGTGAGTGGT<br>GTATCATTGCCTGATTATGGCGTCTCCTGGATAAGGCAGCCCCC<br>GCGAAAGGGTCTTGAATGGCTTGGGGTAATATGGGGCTCAGAG<br>ACAACGTATTATAACTCCGCTCTCAAAAGTCGCTTGACGATAA<br>TAAAAGATAACTCCAAGAGTCAAGTTTTCCTTAAAATGAACAG<br>TTTGCAGACTGACGATACCGCTATATATTATTGTGCTAAACATT<br>ATTACTACGGCGGTAGTTACGCGATGGATTATTGGGGGCAGGG<br>GACTTCTGTCACAGTCAGTAGTGCTGCTGCCTTTGTCCCGGTAT<br>TTCTCCCAGCCAAACCGACCACGACTCCCGCCCCGCGCCCTCC<br>GACACCCGCTCCCACCATCGCCTCTCAACCTCTTAGTCTTCGCC<br>CCGAGGCATGCCGACCCGCCGCCGGGGGTGCTGTTCATACGAG<br>GGGCTTGGACTTCGCTTGTGATATTTACATTTGGGCTCCGTTGG<br>CGGGTACGTGCGGCGTCCTTTTGTTGTCACTCGTTATTACTTTG<br>TATTGTAATCACAGGAATCGCTCAAAGCGGAGTAGGTTGTTGC<br>ATTCCGATTACATGAATATGACTCCTCGCCGGCCTGGGCCGAC<br>AAGAAAACATTACCAACCCTATGCCCCCCCACGAGACTTCGCT<br>GCGTACAGGTCCCGAGTGAAGTTTTCCCGAAGCGCAGACGCTC<br>CGGCATATCAGCAAGGACAGAATCAGCTGTATAACGAACTGAA<br>TTTGGGACGCCGCGAGGAGTATGACGTGCTTGATAAACGCCGG<br>GGGAGAGACCCGGAAATGGGGGGTAAACCCCGAAGAAAGAAT<br>CCCCAAGAAGGACTCTACAATGAACTCCAGAAGGATAAGATG<br>GCGGAGGCCTACTCAGAAATAGGTATGAAGGGCGAACGACGA<br>CGGGGAAAAGGTCACGATGGCCTCTACCAAGGGTTGAGTACGG<br>CAACCAAAGATACGTACGATGCACTGCATATGCAGGCCCTGCC<br>TCCCAGAGGAAGCGGAGCTACTAACTTCAGCCTGCTGAAGCAG<br>GCTGGAGACGTGGAGGAGAACCCTGGACCTATGGTGAGCAAG<br>GGCGAGGAGCTGTTCACCGGGGTGGTGCCCATCCTGGTCGAGC<br>TGGACGGCGACGTAAACGGCCACAAGTTCAGCGTGTCCGGCGA<br>GGGCGAGGGCGATGCCACCTACGGCAAGCTGACCCTGAAGTTC<br>ATCTGCACCACCGGCAAGCTGCCCGTGCCCTGGCCCACCCTCG<br>TGACCACCCTGACCTACGGCGTGCAGTGCTTCAGCCGCTACCC<br>CGACCACATGAAGCAGCACGACTTCTTCAAGTCCGCCATGCCC<br>GAAGGCTACGTCCAGGAGCGCACCATCTTCTTCAAGGACGACG<br>GCAACTACAAGACCCGCGCCGAGGTGAAGTTCGAGGGCGACA<br>CCCTGGTGAACCGCATCGAGCTGAAGGGCATCGACTTCAAGGA<br>GGACGGCAACATCCTGGGGCACAAGCTGGAGTACAACTACAA<br>CAGCCACAACGTCTATATCATGGCCGACAAGCAGAAGAACGGC<br>ATCAAGGTGAACTTCAAGATCCGCCACAACATCGAGGACGGCA<br>GCGTGCAGCTCGCCGACCACTACCAGCAGAACACCCCCATCGG<br>CGACGCCCCGTGCTGCTGCCCGACAACCACTACCTGAGCACC<br>CAGTCCGCCCTGAGCAAAGACCCCAACGAGAAGCGCGATCAC<br>ATGGTCCTGCTGGAGTTCGTGACCGCCGCCGGGATCACTCTCG<br>GCATGGACGAGCTGTACAAGTAATAATAAAATAAAATCGCTAT<br>CCATCGAAGATGGATGTGTGTTGGTTTTTTGTGTGGTGAGTAGG<br>ATGGAGTGGAAAGGGTGGTGTGTCTCCAGACCGCTGGAAGGCT |

TABLE 35-continued

Donor Template Nucleotide Sequences-Left Homology Arm to Right Homology Arm

| SEQ ID NO: | Description | Sequence |
|---|---|---|
|  |  | TACAGCCTTACCTGGCACTGCCTAGTGGCACCAAGGAGCCTCA<br>TTTACCAGATGTAAGGAACTGTTTGTGCTATGTTAGGGTGAGG<br>GATTAGAGCTGGGGACTAAAGAAAAAGATAGGCCACGGGTGC<br>CTGGGAGAGCGTTCGGGGAGCAGGCAAAGAAGAGCAGTTGGG<br>GTGATCATAGCTATTGTGAGCAGAGAGGTCTCGCTACCTCTAA<br>GTACGAGCTCATTCCAACTTACCCAGCCCTCCAGAACTAACCC<br>AAAAGAGACTGGAAGAGCGAAGCTCCACTCCTTGTTTTGAAGA<br>GACCAGATACTTGCGTCCAAACTCTGCACAGGGCATATATAGC<br>AATTCACTATCTTTGAGACCATAAAACGCCTCGTAATTTTTAGT<br>CCTTTTCAAGTGACCAACAACTTTCAGTTTATTTCATTTTTTTGA<br>AGCAAGATGGATTATGAATTGATAAATAACCAAGAGCATTTCT<br>GTATCTCATATGAGATAAATAATACCAAAAAAAGTTGCCATTT<br>ATTGTCAGATACTGTGTAAAGAAAAAATTATTTAGACGTGTTA<br>ACTGGTTTAATCCTACTTCTGCCTAGGAAGGAAGGTGTTATATC<br>CTCTTTTTAAAATTCTTTTTAATTTTGACTATATAAACTGATAA |
| 1390 | LHA to RHA of CTX-138 | GAGATGTAAGGAGCTGCTGTGACTTGCTCAAGGCCTTATATCG<br>AGTAAACGGTAGTGCTGGGGCTTAGACGCAGGTGTTCTGATTT<br>ATAGTTCAAAACCTCTATCAATGAGAGAGCAATCTCCTGGTAA<br>TGTGATAGATTTCCCAACTTAATGCCAACATACCATAAACCTCC<br>CATTCTGCTAATGCCCAGCCTAAGTTGGGGAGACCACTCCAGA<br>TTCCAAGATGTACAGTTTGCTTTGCTGGGCCTTTTTCCCATGCC<br>TGCCTTTACTCTGCCAGAGTTATATTGCTGGGGTTTTGAAGAAG<br>ATCCTATTAAATAAAAGAATAAGCAGTATTATTAAGTAGCCCT<br>GCATTTCAGGTTTCCTTGAGTGGCAGGCCAGGCCTGGCCGTGA<br>ACGTTCACTGAAATCATGGCCTCTTGGCCAAGATTGATAGCTTG<br>TGCCTGTCCCTGAGTCCCAGTCCATCACGAGCAGCTGGTTTCTA<br>AGATGCTATTTCCCGTATAAAGCATGAGACCGTGACTTGCCAG<br>CCCCACAGAGCCCCGCCCTTGTCCATCACTGGCATCTGGACTCC<br>AGCCTGGGTTGGGCAAAGAGGGAAATGAGATCATGTCCTAAC<br>CCTGATCCTCTTGTCCCACAGATATCCAGAACCCTGACCCTGCC<br>GTGTACCAGCTGAGAGACTCTAAATCCAGTGACAAGTCTGTCT<br>GCCTATTCACCGATTTTGATTCTCAAACAAATGTGTCACAAAGT<br>AAGGATTCTGATGTGTATATCACAGACAAAACTGTGCTAGACA<br>TGAGGTCTATGGACTTCAGGCTCCGGTGCCCGTCAGTGGGCAG<br>AGCGCACATCGCCCACAGTCCCCGAGAAGTTGGGGGGAGGGG<br>TCGGCAATTGAACCGGTGCCTAGAGAAGGTGGCGCGGGGTAA<br>ACTGGGAAAGTGATGTCGTGTACTGGCTCCGCCTTTTTCCCGAG<br>GGTGGGGGAGAACCGTATATAAGTGCAGTAGTCGCCGTGAACG<br>TTCTTTTTCGCAACGGGTTTGCCGCCAGAACACAGGTAAGTGCC<br>GTGTGTGGTTCCCGCGGGCCTGGCCTCTTTTACGGGTTATGCCC<br>TTGCGTGCCTTGAATTACTTCCACTGGCTGCAGTACGTGATTCT<br>TGATCCCGAGCTTCGGGTTGGAAGTGGGTGGGAGAGTTCGAGG<br>CCTTGCGCTTAAGGAGCCCCTTCGCCTCGTGCTTGAGTTGAGGC<br>CTGGCCTGGGCGCTGGGGCCGCCGCGTGCGAATCTGGTGGCAC<br>CTTCGCGCCTGTCTCGCTGCTTTCGATAAGTCTCTAGCCATTTA<br>AAATTTTTGATGACCTGCTGCGACGCTTTTTTTCTGGCAAGATA<br>GTCTTGTAAATGCGGGCCAAGATCTGCACACTGGTATTTCGGTT<br>TTTGGGGCCGCGGGCGGCGACGGGGCCCGTGCGTCCCAGCGCA<br>CATGTTCGGCGAGGCGGGCCTGCGAGCGCGGCCACCGAGAAT<br>CGGACGGGGGTAGTCTCAAGCTGGCCGGCCTGCTCTGGTGCCT<br>GGCCTCGCGCCGCCGTGTATCGCCCCGCCCTGGGCGGCAAGGC<br>TGGCCCGGTCGGCACCAGTTGCGTGAGCGGAAAGATGGCCGCT<br>TCCCGGCCCTGCTGCAGGGAGCTCAAAATGGAGGACGCGGCGC<br>TCGGGAGAGCGGGCGGGTGAGTCACCCACACAAAGGAAAAGG<br>GCCTTTCCGTCCTCAGCCGTCGCTTCATGTGACTCCACGGAGTA<br>CCGGGCGCCGTCCAGGCACCTCGATTAGTTCTCGAGCTTTTGGA<br>GTACGTCGTCTTTAGGTTGGGGGGAGGGGTTTTATGCGATGGA<br>GTTTCCCCACACTGAGTGGGTGGAGACTGAAGTTAGGCCAGCT<br>TGGCACTTGATGTAATTCTCCTTGGAATTTGCCCTTTTTGAGTTT<br>GGATCTTGGTTCATTCTCAAGCCTCAGACAGTGGTTCAAAGTTT<br>TTTTCTTCCATTTCAGGTGTCGTGACCACCATGCTTCTTTTGGTT<br>ACGTCTCTGTTGCTTTGCGAACTTCCTCATCCAGCGTTCTTGCT<br>GATCCCCGATATTCAGATGACTCAGACCACCAGTAGCTTGTCT<br>GCCTCACTGGGAGACCGAGTAACAATCTCCTGCAGGGCAAGTC<br>AAGACATTAGCAAATACCTCAATTGGTACCAGCAGAAGCCCGA<br>CGGAACGGTAAAACTCCTCATCTATCATACGTCAAGGTTGCAT<br>TCCGGAGTACCGTCACGATTTTCAGGTTCTGGGAGCGGAACTG<br>ACTATTCCTTGACTATTTCAAACCTCGAGCAGGAGGACATTGC<br>GACATATTTTGTCAACAAGGTAATACCCTCCCTTACACTTTCG<br>GAGGAGGAACCAAACTCGAAATTACCGGGTCCACCAGTGGCTC<br>TGGGAAGCCTGGCAGTGGAGAAGGTTCCACTAAAGGCGAGGT<br>GAAGCTCCAGGAGAGCGGCCCCGGTCTCGTTGCCCCAGTCAA<br>AGCCTCTCTGTAACGTGCACAGTGAGTGGTGTATCATTGCCTGA<br>TTATGGCGTCTCCTGGATAAGGCAGCCCCCGCGAAAGGGTCTT |

TABLE 35-continued

Donor Template Nucleotide Sequences-Left Homology Arm to Right Homology Arm

| SEQ ID NO: | Description | Sequence |
|---|---|---|
| | | GAATGGCTTGGGGTAATATGGGGCTCAGAGACAACGTATTATA<br>ACTCCGCTCTCAAAAGTCGCTTGACGATAATAAAAGATAACTC<br>CAAGAGTCAAGTTTTCCTTAAAATGAACAGTTTGCAGACTGAC<br>GATACCGCTATATATTATTGTGCTAAACATTATTACTACGGCGG<br>TAGTTACGCGATGGATTATTGGGGGCAGGGGACTTCTGTCACA<br>GTCAGTAGTGCTGCTGCCTTTGTCCCGGTATTTCTCCCAGCCAA<br>ACCGACCACGACTCCCGCCCCGCGCCCTCCGACACCCGCTCCC<br>ACCATCGCCTCTCAACCTCTTAGTCTTCGCCCCGAGGCATGCCG<br>ACCCGCCGCCGGGGGTGCTGTTCATACGAGGGGCTTGGACTTC<br>GCTTGTGATATTTACATTTGGGCTCCGTTGGCGGGTACGTGCGG<br>CGTCCTTTTGTTGTCACTCGTTATTACTTTGTATTGTAATCACAG<br>GAATCGCTCAAAGCGGAGTAGGTTGTTGCATTCCGATTACATG<br>AATATGACTCCTCGCCGGCCTGGGCCGACAAGAAAACATTACC<br>AACCCTATGCCCCCCCACGAGACTTCGCTGCGTACAGGTCCCG<br>AGTGAAGTTTTCCCGAAGCGCAGACGCTCCGGCATATCAGCAA<br>GGACAGAATCAGCTGTATAACGAACTGAATTTGGGACGCCGCG<br>AGGAGTATGACGTGCTTGATAAACGCCGGGGGAGAGACCCGG<br>AAATGGGGGGTAAACCCCGAAGAAAGAATCCCCAAGAAGGAC<br>TCTACAATGAACTCCAGAAGGATAAGATGGCGGAGGCCTACTC<br>AGAAATAGGTATGAAGGGCGAACGACGACGGGGAAAAGGTCA<br>CGATGGCCTCTACCAAGGGTTGAGTACGGCAACCAAAGATACG<br>TACGATGCACTGCATATGCAGGCCCTGCCTCCCAGATAATAAT<br>AAAATCGCTATCCATCGAAGATGGATGTGTGTTGGTTTTTTGTG<br>TGTGGAGCAACAAATCTGACTTTGCATGTGCAAACGCCTTCAA<br>CAACAGCATTATTCCAGAAGACACCTTCTTCCCCAGCCCAGGT<br>AAGGGCAGCTTTGGTGCCTTCGCAGGCTGTTTCCTTGCTTCAGG<br>AATGGCCAGGTTCTGCCCAGAGCTCTGGTCAATGATGTCTAAA<br>ACTCCTCTGATTGGTGGTCTCGGCCTTATCCATTGCCACCAAAA<br>CCCTCTTTTTACTAAGAAACAGTGAGCCTTGTTCTGGCAGTCCA<br>GAGAATGACACGGGAAAAAAGCAGATGAAGAGAAGGTGGCAG<br>GAGAGGGCACGTGGCCCAGCCTCAGTCTCTCCAACTGAGTTCC<br>TGCCTGCCTGCCTTTGCTCAGACTGTTTGCCCCTTACTGCTCTTC<br>TAGGCCTCATTCTAAGCCCCTTCTCCAAGTTGCCTCTCCTTATTT<br>CTCCCTGTCTGCCAAAAAATCTTTCCCAGCTCACTAAGTCAGTC<br>TCACGCAGTCACTCATTAACCCACCAATCACTGATTGTGCCGGC<br>ACATGAATGCACCAGGTGTTGAAGTGGAGGAATTAAAAAGTCA<br>GATGAGGGGTGTGCCCAGAGGAAGCACCATTCTAGTTGGGGGA<br>GCCCATCTGTCAGCTGGGAAAAGTCCAAATAACTTCAGATTGG<br>AATGTGTTTTAACTCAGGGTTGAGAAAACAGCTACCTTCAGGA<br>CAAAAGTCAGGGAAGGGCTCTCTGAAGAAATGCTACTTGAAGA<br>TACCAGCCCTACCAAGGGCAGGGAGAGGACCCTATAGAGGCCT<br>GGGACAGGAGCTCAATGAGAAAGG |
| 1391 | LHA to RHA of CTX-139 | GAGATGTAAGGAGCTGCTGTGACTTGCTCAAGGCCTTATATCG<br>AGTAAACGGTAGTGCTGGGGCTTAGACGCAGGTGTTCTGATTT<br>ATAGTTCAAAACCTCTATCAATGAGAGAGCAATCTCCTGGTAA<br>TGTGATAGATTTCCCAACTTAATGCCAACATACCATAAACCTCC<br>CATTCTGCTAATGCCCAGCCTAAGTTGGGGAGACCACTCCAGA<br>TTCCAAGATGTACAGTTTGCTTTGCTGGGCCTTTTTCCCATGCC<br>TGCCTTTACTCTGCCAGAGTTATATTGCTGGGGTTTTGAAGAAG<br>ATCCTATTAAATAAAAGAATAAGCAGTATTATTAAGTAGCCCT<br>GCATTTCAGGTTTCCTTGAGTGGCAGGCCAGGCCTGGCCGTGA<br>ACGTTCACTGAAATCATGGCCTCTTGGCCAAGATTGATAGCTTG<br>TGCCTGTCCCTGAGTCCCAGTCCATCACGAGCAGCTGGTTTCTA<br>AGATGCTATTTCCCGTATAAAGCATGAGACCGTGACTTGCCAG<br>CCCCACAGAGCCCCGCCCTTGTCCATCACTGGCATCTGGACTCC<br>AGCCTGGGTTGGGGCAAAGAGGGAAATGAGATCATGTCCTAAC<br>CCTGATCCTCTTGTCCCACAGATATCCAGAACCCTGACCCTGCC<br>GTGTACCAGCTGAGAGACTCTAAATCGGCTCCGGTGCCCGTCA<br>GTGGGCAGAGCGCACATCGCCCACAGTCCCCGAGAAGTTGGGG<br>GGAGGGGTCGGCAATTGAACCGGTGCCTAGAGAAGGTGGCGC<br>GGGGTAAACTGGGAAAGTGATGTCGTGTACTGGCTCCGCCTTT<br>TTCCCGAGGGTGGGGGAGAACCGTATATAAGTGCAGTAGTCGC<br>CGTGAACGTTCTTTTTCGCAACGGGTTTGCCGCCAGAACACAG<br>GTAAGTGCCGTGTGTGGTTCCCGCGGGCTGGCCTCTTTACGGG<br>TTATGGCCCTTGCGTGCCTTGAATTACTTCCACTGGCTGCAGTA<br>CGTGATTCTTGATCCCGAGCTTCGGGTTGGAAGTGGGTGGGAG<br>AGTTCGAGGCCTTGCGCTTAAGGAGCCCCTTCGCCTCGTGCTTG<br>AGTTGAGGCCTGGCCTGGGCGCTGGGGCGCGCGTGCGAATC<br>TGGTGGCACCTTCGCGCCTGTCTCGCTGCTTTCGATAAGTCTCT<br>AGCCATTTAAAATTTTTGATGACCTGCTGCGACGCTTTTTTTCT<br>GGCAAGATAGTCTTGTAAATGCGGGCCAAGATCTGCACACTGG<br>TATTTCGGTTTTTGGGGCCGCGGGCGGCGACGGGGCCCGTGCG<br>TCCCAGCGCACATGTTCGGCGAGGCGGGGCCTGCGAGCGCGGC<br>CACCGAGAATCGGACGGGGGTAGTCTCAAGCTGGCCGGCCTGC |

TABLE 35-continued

Donor Template Nucleotide Sequences-Left Homology Arm to Right Homology Arm

| SEQ ID NO: | Description | Sequence |
|---|---|---|
| | | TCTGGTGCCTGGCCTCGCGCCGCCGTGTATCGCCCCGCCCTGGG<br>CGGCAAGGCTGGCCCGGTCGGCACCAGTTGCGTGAGCGGAAA<br>GATGGCCGCTTCCCGGCCCTGCTGCAGGGAGCTCAAAATGGAG<br>GACGCGGCGCTCGGGAGAGCGGGCGGGTGAGTCACCCACACA<br>AAGGAAAAGGGCCTTTCCGTCCTCAGCCGTCGCTTCATGTGAC<br>TCCACGGAGTACCGGGCGCCGTCCAGGCACCTCGATTAGTTCT<br>CGAGCTTTTGGAGTACGTCGTCTTTAGGTTGGGGGGAGGGGTTT<br>TATGCGATGGAGTTTCCCCACACTGAGTGGGTGGAGACTGAAG<br>TTAGGCCAGCTTGGCACTTGATGTAATTCTCCTTGGAATTTGCC<br>CTTTTTGAGTTTGGATCTTGGTTCATTCTCAAGCCTCAGACAGT<br>GGTTCAAAGTTTTTTTCTTCCATTTCAGGTGTCGTGACCACCAT<br>GCTTCTTTTGGTTACGTCTCTGTTGCTTTGCGAACTTCCTCATCC<br>AGCGTTCTTGCTGATCCCCGATATTCAGATGACTCAGACCACCA<br>GTAGCTTGTCTGCCTCACTGGGAGACCGAGTAACAATCTCCTG<br>CAGGGCAAGTCAAGACATTAGCAAATACCTCAATTGGTACCAG<br>CAGAAGCCCGACGGAACGGTAAAACTCCTCATCTATCATACGT<br>CAAGGTTGCATTCCGGAGTACCGTCACGATTTTCAGGTTCTGGG<br>AGCGGAACTGACTATTCCTTGACTATTTCAAACCTCGAGCAGG<br>AGGACATTGCGACATATTTTTGTCAACAAGGTAATACCCTCCCT<br>TACACTTTCGGAGGAGGAACCAAACTCGAAATTACCGGGTCCA<br>CCAGTGGCTCTGGGAAGCCTGGCAGTGGAGAAGGTTCCACTAA<br>AGGCGAGGTGAAGCTCCAGGAGAGCGGCCCCGGTCTCGTTGCC<br>CCCAGTCAAAGCCTCTCTGTAACGTGCACAGTGAGTGGTGTAT<br>CATTGCCTGATTATGGCGTCTCCTGGATAAGGCAGCCCCCGCG<br>AAAGGGTCTTGAATGGCTTGGGGTAATATGGGGCTCAGAGACA<br>ACGTATTATAACTCCGCTCTCAAAAGTCGCTTGACGATAATAA<br>AAGATAACTCCAAGAGTCAAGTTTTCCTTAAAATGAACAGTTT<br>GCAGACTGACGATACCGCTATATATTATTGTGCTAAACATTATT<br>ACTACGGCGGTAGTTACGCGATGGATTATTGGGGGCAGGGGAC<br>TTCTGTCACAGTCAGTAGTGCTGCTGCCTTTGTCCCGGTATTTC<br>TCCCAGCCAAACCGACCACGACTCCCGCCCCGCGCCCTCCGAC<br>ACCCGCTCCCACCATCGCCTCTCAACCTCTTAGTCTTCGCCCCG<br>AGGCATGCCGACCCGCCGCCGGGGGTGCTGTTCATACGAGGGG<br>CTTGGACTTCGCTTGTGATATTTACATTTGGGCTCCGTTGGCGG<br>GTACGTGCGGCGTCCTTTTGTTGTCACTCGTTATTACTTTGTATT<br>GTAATCACAGGAATCGCTCAAAGCGGAGTAGGTTGTTGCATTC<br>CGATTACATGAATATGACTCCTCGCCGGCCTGGGCCGACAAGA<br>AAACATTACCAACCCTATGCCCCCCCACGAGACTTCGCTGCGT<br>ACAGGTCCCGAGTGAAGTTTTCCCGAAGCGCAGACGCTCCGGC<br>ATATCAGCAAGGACAGAATCAGCTGTATAACGAACTGAATTTG<br>GGACGCCGCGAGGAGTATGACGTGCTTGATAAACGCCGGGGG<br>AGAGACCCGGAAATGGGGGGTAAACCCCGAAGAAAGAATCCC<br>CAAGAAGGACTCTACAATGAACTCCAGAAGGATAAGATGGCG<br>GAGGCCTACTCAGAAATAGGTATGAAGGGCGAACGACGACGG<br>GGAAAAGGTCACGATGGCCTCTACCAAGGGTTGAGTACGGCAA<br>CCAAAGATACGTACGATGCACTGCATATGCAGGCCCTGCCTCC<br>CAGATAATAATAAAATCGCTATCCATCGAAGATGGATGTGTGT<br>TGGTTTTTTGTGTGTGGAGCAACAAATCTGACTTTGCATGTGCA<br>AACGCCTTCAACAACAGCATTATTCCAGAAGACACCTTCTTCCC<br>CAGCCCAGGTAAGGGCAGCTTTGGTGCCTTCGCAGGCTGTTTC<br>CTTGCTTCAGGAATGGCCAGGTTCTGCCCAGAGCTCTGGTCAAT<br>GATGTCTAAAACTCCTCTGATTGGTGGTCTCGGCCTTATCCATT<br>GCCACCAAAACCCTCTTTTTACTAAGAAACAGTGAGCCTTGTTC<br>TGGCAGTCCAGAGAATGACACGGGAAAAAAGCAGATGAAGAG<br>AAGGTGGCAGGAGAGGGCACGTGGCCCAGCCTCAGTCTCTCCA<br>ACTGAGTTCCTGCCTGCCTGCCTTTGCTCAGACTGTTTGCCCCT<br>TACTGCTCTTCTAGGCCTCATTCTAAGCCCCTTCTCCAAGTTGC<br>CTCTCCTTATTTCTCCCTGTCTGCCAAAAAATCTTTCCCAGCTCA<br>CTAAGTCAGTCTCACGCAGTCACTCATTAACCCACCAATCACTG<br>ATTGTGCCGGCACATGAATGCACCAGGTGTTGAAGTGGAGGAA<br>TTAAAAAGTCAGATGAGGGGTGTGCCCAGAGGAAGCACCATTC<br>TAGTTGGGGGAGCCCATCTGTCAGCTGGGAAAAGTCAAATAA<br>CTTCAGATTGGAATGTGTTTTAACTCAGGGTTGAGAAAACAGC<br>TACCTTCAGGACAAAAGTCAGGGAAGGGCTCTCTGAAGAAATG<br>CTACTTGAAGATACCAGCCCTACCAAGGGCAGGGAGAGGACCC<br>TATAGAGGCCTGGGACAGGAGCTCAATGAGAAAGG |
| 1392 | LHA to RHA of CTX-140 | TAATCCTCCGGCAAACCTCTGTTTCCTCCTCAAAAGGCAGGAG<br>GTCGGAAAGAATAAACAATGAGAGTCACATTAAAAACACAAA<br>ATCCTACGGAAATACTGAAGAATGAGTCTCAGCACTAAGGAAA<br>AGCCTCCAGCAGCTCCTGCTTTCTGAGGGTGAAGGATAGACGC<br>TGTGGCTCTGCATGACTCACTAGCACTCTATCACGGCCATATTC<br>TGGCAGGGTCAGTGGCTCCAACTAACATTTGTTTGGTACTTTAC<br>AGTTTATTAAATAGATGTTTATATGGAGAAGCTCTCATTTCTTT<br>CTCAGAAGAGCCTGGCTAGGAAGGTGGATGAGGCACCATATTC |

TABLE 35-continued

Donor Template Nucleotide Sequences-Left Homology Arm to Right Homology Arm

| SEQ ID NO: | Description | Sequence |
|---|---|---|
| | | ATTTTGCAGGTGAAATTCCTGAGATGTAAGGAGCTGCTGTGAC
TTGCTCAAGGCCTTATATCGAGTAAACGGTAGTGCTGGGGCTT
AGACGCAGGTGTTCTGATTTATAGTTCAAAACCTCTATCAATGA
GAGAGCAATCTCCTGGTAATGTGATAGATTTCCCAACTTAATG
CCAACATACCATAAACCTCCCATTCTGCTAATGCCCAGCCTAA
GTTGGGGAGACCACTCCAGATTCCAAGATGTACAGTTTGCTTT
GCTGGGCCTTTTTCCCATGCCTGCCTTTACTCTGCCAGAGTTAT
ATTGCTGGGGTTTTGAAGAAGATCCTATTAAATAAAAGAATAA
GCAGTATTATTAAGTAGCCCTGCATTTCAGGTTTCCTTGAGTGG
CAGGCCAGGCCTGGCCGTGAACGTTCACTGAAATCATGGCCTC
TTGGCCAAGATTGATAGCTTGTGCCTGTCCCTGAGTCCCAGTCC
ATCACGAGCAGCTGGTTTCTAAGATGCTATTTCCCGTATAAAGC
ATGAGACCGTGACTTGCCAGCCCCACAGAGCCCCGCCCTTGTC
CATCACTGGCATCTGGACTCCAGCCTGGGTTGGGGCAAAGAGG
GAAATGAGATCATGTCCTAACCCTGATCCTCTTGTCCCACAGAT
ATCGGAAGCGGAGCTACTAACTTCAGCCTGCTGAAGCAGGCTG
GAGACGTGGAGGAGAACCCTGGACCCATGCTTCTTTTGGTTAC
GTCTCTGTTGCTTTGCGAACTTCCTCATCCAGCGTTCTTGCTGAT
CCCCGATATTCAGATGACTCAGACCACCAGTAGCTTGTCTGCCT
CACTGGGAGACCGAGTAACAATCTCCTGCAGGGCAAGTCAAGA
CATTAGCAAATACCTCAATTGGTACCAGCAGAAGCCCGACGGA
ACGGTAAAACTCCTCATCTATCATACGTCAAGGTTGCATTCCGG
AGTACCGTCACGATTTTCAGGTTCTGGGAGCGGAACTGACTAT
TCCTTGACTATTTCAAACCTCGAGCAGGAGGACATTGCGACAT
ATTTTTGTCAACAAGGTAATACCCTCCCTTACACTTTCGGAGGA
GGAACCAAACTCGAAATTACCGGGTCCACCAGTGGCTCTGGGA
AGCCTGGCAGTGGAGAAGGTTCCACTAAAGGCGAGGTGAAGC
TCCAGGAGAGCGGCCCCGGTCTCGTTGCCCCCAGTCAAAGCCT
CTCTGTAACGTGCACAGTGAGTGGTGTATCATTGCCTGATTATG
GCGTCTCCTGGATAAGGCAGCCCCCGCGAAAGGGTCTTGAATG
GCTTGGGGTAATATGGGGCTCAGAGACAACGTATTATAACTCC
GCTCTCAAAAGTCGCTTGACGATAATAAAAGATAACTCCAAGA
GTCAAGTTTTCCTTAAAATGAACAGTTTGCAGACTGACGATAC
CGCTATATATTATTGTGCTAAACATTATTACTACGGCGGTAGTT
ACGCGATGGATTATTGGGGCAGGGGACTTCTGTCACAGTCAG
TAGTGCTGCTGCCTTTGTCCCGGTATTTCTCCCAGCCAAACCGA
CCACGACTCCCGCCCCGCGCCCTCCGACACCCGCTCCCACCATC
GCCTCTCAACCTCTTAGTCTTCGCCCCGAGGCATGCCGACCCGC
CGCCGGGGGTGCTGTTCATACGAGGGGCTTGGACTTCGCTTGT
GATATTTACATTTGGGCTCCGTTGGCGGGTACGTGCGGCGTCCT
TTTGTTGTCACTCGTTATTACTTTGTATTGTAATCACAGGAATC
GCTCAAAGCGGAGTAGGTTGTTGCATTCCGATTACATGAATAT
GACTCCTCGCCGGCCTGGGCCGACAAGAAAACATTACCAACCC
TATGCCCCCCCACGAGACTTCGCTGCGTACAGGTCCCGAGTGA
AGTTTTCCCGAAGCGCAGACGCTCCGGCATATCAGCAAGGACA
GAATCAGCTGTATAACGAACTGAATTTGGGACGCCGCGAGGAG
TATGACGTGCTTGATAAACGCCGGGGAGAGACCCGGAAATG
GGGGGTAAACCCCGAAGAAAGAATCCCCAAGAAGGACTCTAC
AATGAACTCCAGAAGGATAAGATGGCGGAGGCCTACTCAGAA
ATAGGTATGAAGGGCGAACGACGACGGGGAAAAGGTCACGAT
GGCCTCTACCAAGGGTTGAGTACGGCAACCAAAGATACGTACG
ATGCACTGCATATGCAGGCCCTGCCTCCCAGATAATAATAAAA
TCGCTATCCATCGAAGATGGATGTGTGTTGGTTTTTTGTGTGCC
AGTGACAAGTCTGTCTGCCTATTCACCGATTTTGATTCTCAAAC
AAATGTGTCACAAAGTAAGGATTCTGATGTGTATATCACAGAC
AAAACTGTGCTAGACATGAGGTCTATGGACTTCAAGAGCAACA
GTGCTGTGGCCTGGAGCAACAAATCTGACTTTGCATGTGCAAA
CGCCTTCAACAACAGCATTATTCCAGAAGACACCTTCTTCCCCA
GCCCAGGTAAGGGCAGCTTTGGTGCCTTCGCAGGCTGTTTCCTT
GCTTCAGGAATGGCCAGGTTCTGCCCAGAGCTCTGGTCAATGA
TGTCTAAAACTCCTCTGATTGGTGGTCTCGGCCTTATCCATTGC
CACCAAAACCCTCTTTTTACTAAGAAACAGTGAGCCTTGTTCTG
GCAGTCCAGAATGACACGGGAAAAAAGCAGATGAAGAGAA
GGTGGCAGGAGAGGGCACGTGGCCCAGCCTCAGTCTCTCCAAC
TGAGTTCCTGCCTGCCTGCCTTTGCTCAGACTGTTTGCCCCTTA
CTGCTCTTCTAGGCCTCATTCTAAGCCCCTTCTCCAAGTTGCCT
CTCCTTATTTCTCCCTGTCTGCCAAAAAATCTTTCCCAGCTCACT
AAGTCAGTCTCACGCAGTCACTCATTAACCCACCAATCACTGA
TTGTGCCGGCACATGAATGCACCAGGTGTTGAAGTGGAGGAAT
TAAAAAGTCAGATGAGGGGTGTGCCCAGAGGAAGCACCATTCT
AGTTGGGGGAGCCCATCTGTCAGCTGGGAAAAGTCCAAATAAC
TTCAGATTGGAATGTGTTTTAACTCAGGGTTGAGAAAACAGCT
ACCTTCAGGACAAAAGTCAGGGAAGGGCTCTCTGAAGAAATGC
TACTTGAAGATACCAGCCCTACCAAGGGCAGGGAGAGGACCCT
ATAGAGGCCTGGGACAGGAGCTCAATGAGAAAGGAGAAGAGC |

TABLE 35-continued

Donor Template Nucleotide Sequences-Left Homology Arm to Right Homology Arm

| SEQ ID NO: | Description | Sequence |
|---|---|---|
| | | AGCAGGCATGAGTTGAATGAAGGAGGCAGGGCCGGGTCACAG GG |
| 1393 | LHA to RHA of CTX-141 | TAATCCTCCGGCAAACCTCTGTTTCCTCCTCAAAAGGCAGGAG GTCGGAAAGAATAAACAATGAGAGTCACATTAAAAACACAAA ATCCTACGGAAATACTGAAGAATGAGTCTCAGCACTAAGGAAA AGCCTCCAGCAGCTCCTGCTTTCTGAGGGTGAAGGATAGACGC TGTGGCTCTGCATGACTCACTAGCACTCTATCACGGCCATATTC TGGCAGGGTCAGTGGCTCCAACTAACATTTGTTTGGTACTTTAC AGTTTATTAAATAGATGTTTATATGGAGAAGCTCTCATTTCTTT CTCAGAAGAGCCTGGCTAGGAAGGTGGATGAGGCACCATATTC ATTTTGCAGGTGAAATTCCTGAGATGTAAGGAGCTGCTGTGAC TTGCTCAAGGCCTTATATCGAGTAAACGGTAGTGCTGGGGCTT AGACGCAGGTGTTCTGATTTATAGTTCAAAACCTCTATCAATGA GAGAGCAATCTCCTGGTAATGTGATAGATTTCCCAACTTAATG CCAACATACCATAAACCTCCCATTCTGCTAATGCCCAGCCTAA GTTGGGGAGACCACTCCAGATTCCAAGATGTACAGTTTGCTTT GCTGGGCCTTTTTCCCATGCCTGCCTTTACTCTGCCAGAGTTAT ATTGCTGGGGTTTTGAAGAAGATCCTATTAAATAAAAGAATAA GCAGTATTATTAAGTAGCCCTGCATTTCAGGTTTCCTTGAGTGG CAGGCCAGGCCTGGCCGTGAACGTTCACTGAAATCATGGCCTC TTGGCCAAGATTGATAGCTTGTGCCTGTCCCTGAGTCCCAGTCC ATCACGAGCAGCTGGTTTCTAAGATGCTATTTCCCGTATAAAGC ATGAGACCGTGACTTGCCAGCCCCACAGAGCCCCGCCCTTGTC CATCACTGGCATCTGGACTCCAGCCTGGGTTGGGGCAAAGAGG GAAATGAGATCATGTCCTAACCCTGATCCTCTTGTCCCACAGAT ATCGGAAGCGGAGCTACTAACTTCAGCCTGCTGAAGCAGGCTG GAGACGTGGAGGAGAACCCTGGACCCATGCTTCTTTTGGTTAC GTCTCTGTTGCTTTGCGAACTTCCTCATCCAGCGTTCTTGCTGAT CCCCGATATTCAGATGACTCAGACCACCAGTAGCTTGTCTGCCT CACTGGGAGACCGAGTAACAATCCTGCAGGGCAAGTCAAGA CATTAGCAAATACCTCAATTGGTACCAGCAGAAGCCCGACGGA ACGGTAAAACTCCTCATCTATCATACGTCAAGGTTGCATTCCGG AGTACCGTCACGATTTTCAGGTTCTGGGAGCGGAACTGACTAT TCCTTGACTATTTCAAACCTCGAGCAGGAGGACATTGCGACAT ATTTTTGTCAACAAGGTAATACCCTCCCTTACACTTTCGGAGGA GGAACCAAACTCGAAATTACCGGGTCACCAGTGGCTCTGGGA AGCCTGGCAGTGGAGAAGGTTCCACTAAAGGCGAGGTGAAGC TCCAGGAGAGCGGCCCCGGTCTCGTTGCCCCCAGTCAAAGCCT CTCTGTAACGTGCACAGTGAGTGGTGTATCATTGCCTGATTATG GCGTCTCCTGGATAAGGCAGCCCCCGCGAAAGGGTCTTGAATG GCTTGGGGTAATATGGGGCTCAGAGACAACGTATTATAACTCC GCTCTCAAAAGTCGCTTGACGATAATAAAAGATAACTCCAAGA GTCAAGTTTTCCTTAAAATGAACAGTTTGCAGACTGACGATAC CGCTATATATTATTGTGCTAAACATTATTACTACGGCGGTAGTT ACGCGATGGATTATTGGGGCAGGGGACTTCTGTCACAGTCAG TAGTGCTGCTGCCTTTGTCCCGGTATTTCTCCCAGCCAAACCGA CCACGACTCCCGCCCCGCGCCCTCCGACACCCGCTCCCACCATC GCCTCTCAACCTCTTAGTCTTCGCCCCGAGGCATGCCGACCCGC CGCCGGGGTGCTGTTCATACGAGGGGCTTGGACTTCGCTTGT GATATTTACATTTGGGCTCCGTTGGCGGGTACGTGCGGCGTCCT TTTGTTGTCACTCGTTATTACTTTGTATTGTAATCACAGGAATC GCTCAAAGCGGGAGTAGGTTGTTGCATTCCGATTACATGAATAT GACTCCTCGCCGGCCTGGGCCGACAAGAAAACATTACCAACCC TATGCCCCCCCACGAGACTTCGCTGCGTACAGGTCCCGAGTGA AGTTTTCCCGAAGCGCAGACGCTCCGGCATATCAGCAAGGACA GAATCAGCTGTATAACGAACTGAATTTGGGACGCCGCGAGGAG TATGACGTGCTTGATAAACGCCGGGGGAGAGACCCCGGAAATG GGGGGTAAACCCCGAAGAAAGAATCCCCAAGAAGGACTCTAC AATGAACTCCAGAAGGATAAGATGGCGGAGGCCTACTCAGAA ATAGGTATGAAGGGCGAACGACGACGGGGAAAAGGTCACGAT GGCCTCTACCAAGGGTTGAGTACGGCAACCAAAGATACGTACG ATGCACTGCATATGCAGGCCCTGCCTCCCAGAGGAAGCGGAGC TACTAACTTCAGCCTGCTGAAGCAGGCTGGAGACGTGGAGGAG AACCCTGGACCTATGGTGAGCAAGGGCGAGGAGCTGTTCACCG GGGTGGTGCCCATCCTGGTCGAGCTGGACGGCGACGTAAACGG CCACAAGTTCAGCGTGTCCGGCGAGGGCGAGGGCGATGCCACC TACGGCAAGCTGACCCTGAAGTTCATCTGCACCACCGGCAAGC TGCCCGTGCCCTGGCCCACCCTCGTGACCACCCTGACCTACGGC GTGCAGTGCTTCAGCCGCTACCCCGACCACATGAAGCAGCACG ACTTCTTCAAGTCCGCCATGCCCGAAGGCTACGTCCAGGAGCG CACCATCTTCTTCAAGGACGACGGCAACTACAAGACCCGCGCC GAGGTGAAGTTCGAGGGCGACACCCTGGTGAACCGCATCGAGC TGAAGGGCATCGACTTCAAGGAGGACGGCAACATCCTGGGGC ACAAGCTGGAGTACAACTACAACAGCCACAACGTCTATATCAT |

TABLE 35-continued

Donor Template Nucleotide Sequences-Left Homology Arm to Right Homology Arm

| SEQ ID NO: | Description | Sequence |
|---|---|---|
| | | GGCCGACAAGCAGAAGAACGGCATCAAGGTGAACTTCAAGAT
CCGCCACAACATCGAGGACGGCAGCGTGCAGCTCGCCGACCAC
TACCAGCAGAACACCCCCATCGGCGACGGCCCCGTGCTGCTGC
CCGACAACCACTACCTGAGCACCCAGTCCGCCCTGAGCAAAGA
CCCCAACGAGAAGCGCGATCACATGGTCCTGCTGGAGTTCGTG
ACCGCCGCCGGGATCACTCTCGGCATGGACGAGCTGTACAAGT
AATAATAAAATCGCTATCCATCGAAGATGGATGTGTGTTGGTTT
TTTGTGTGCCAGTGACAAGTCTGTCTGCCTATTCACCGATTTTG
ATTCTCAAACAAATGTGTCACAAAGTAAGGATTCTGATGTGTA
TATCACAGACAAAACTGTGCTAGACATGAGGTCTATGGACTTC
AAGAGCAACAGTGCTGTGGCCTGGAGCAACAAATCTGACTTTG
CATGTGCAAACGCCTTCAACAACAGCATTATTCCAGAAGACAC
CTTCTTCCCCAGCCCAGGTAAGGGCAGCTTTGGTGCCTTCGCAG
GCTGTTTCCTTGCTTCAGGAATGGCCAGGTTCTGCCCAGAGCTC
TGGTCAATGATGTCTAAAACTCCTCTGATTGGTGGTCTCGGCCT
TATCCATTGCCACCAAAACCCTCTTTTTACTAAGAAACAGTGAG
CCTTGTTCTGGCAGTCCAGAGAATGACACGGGAAAAAAGCAGA
TGAAGAGAAGGTGGCAGGAGAGGGCACGTGGCCCAGCCTCAG
TCTCTCCAACTGAGTTCCTGCCTGCCTGCCTTTGCTCAGACTGT
TTGCCCCTTACTGCTCTTCTAGGCCTCATTCTAAGCCCCTTCTCC
AAGTTGCCTCTCCTTATTTCTCCCTGTCTGCCAAAAAATCTTTCC
CAGCTCACTAAGTCAGTCTCACGCAGTCACTCATTAACCCACC
AATCACTGATTGTGCCGGCACATGAATGCACCAGGTGTTGAAG
TGGAGGAATTAAAAAGTCAGATGAGGGGTGTGCCCAGAGGAA
GCACCATTCTAGTTGGGGGAGCCCATCTGTCAGCTGGGAAAAG
TCCAAATAACTTCAGATTGGAATGTGTTTTAACTCAGGGTTGAG
AAAACAGCTACCTTCAGGACAAAAGTCAGGGAAGGGCTCTCTG
AAGAAATGCTACTTGAAGATACCAGCCCTACCAAGGGCAGGG
AGAGGACCCTATAGAGGCCTGGGACAGGAGCTCAATGAGAAA
GGAGAAGAGCAGCAGGCATGAGTTGAATGAAGGAGGCAGGGC
CGGGTCACAGGG |
| 1394 | LHA to RHA of CTX-142 | GAGATGTAAGGAGCTGCTGTGACTTGCTCAAGGCCTTATATCG
AGTAAACGGTAGTGCTGGGGCTTAGACGCAGGTGTTCTGATTT
ATAGTTCAAAACCTCTATCAATGAGAGAGCAATCTCCTGGTAA
TGTGATAGATTTCCCAACTTAATGCCAACATACCATAAACCTCC
CATTCTGCTAATGCCCAGCCTAAGTTGGGGAGACCACTCCAGA
TTCCAAGATGTACAGTTTGCTTTGCTGGGCCTTTTTCCCATGCC
TGCCTTTACTCTGCCAGAGTTATATTGCTGGGGTTTTGAAGAAG
ATCCTATTAAATAAAAGAATAAGCAGTATTATTAAGTAGCCCT
GCATTTCAGGTTTCCTTGAGTGGCAGGCCAGGCCTGGCCGTGA
ACGTTCACTGAAATCATGGCCTCTTGGCCAAGATTGATAGCTTG
TGCCTGTCCCTGAGTCCCAGTCCATCACGAGCAGCTGGTTTCTA
AGATGCTATTTCCCGTATAAAGCATGAGACCGTGACTTGCCAG
CCCCACAGAGCCCCGCCCTTGTCCATCACTGGCATCTGGACTCC
AGCCTGGGTTGGGGCAAAGAGGGAAATGAGATCATGTCCTAAC
CCTGATCCTCTTGTCCCACAGATATCCAGAACCCTGACCCTGCC
GTGTACCAGCTGAGAGACTCTAAATCCAGTGACAAGTCTGTCT
GCCTATTCACCGATTTTGATTCTCAAACAAATGTGTCACAAAGT
AAGGATTCTGATGTGTATATCACAGACAAAACTGTGCTAGACA
TGAGGTCTATGGACTTCAGGCTCCGGTGCCCGTCAGTGGGCAG
AGCGCACATCGCCCACAGTCCCCGAGAAGTTGGGGGGAGGGG
TCGGCAATTGAACCGGTGCCTAGAGAAGGTGGCGCGGGGTAA
ACTGGGAAAGTGATGTCGTGTACTGGCTCCGCCTTTTTCCCGAG
GGTGGGGGAGAACCGTATATAAGTGCAGTAGTCGCCGTGAACG
TTCTTTTTCGCAACGGGTTTGCCGCCAGAACACAGGTAAGTGCC
GTGTGTGGTTCCCGCGGGCCTGGCCTCTTTACGGGTTATGGCCC
TTGCGTGCCTTGAATTACTTCCACTGGCTGCAGTACGTGATTCT
TGATCCCGAGCTTCGGGTTGGAAGTGGGTGGGAGAGTTCGAGG
CCTTGCGCTTAAGGAGCCCCTTCGCCTCGTGCTTGAGTTGAGGC
CTGGCCTGGGCGCTGGGGCCGCCGCGTGCGAATCGGTGGCAC
CTTCGCGCCTGTCTCGCTGCTTTCGATAAGTCTCTAGCCATTTA
AAATTTTTGATGACCTGCTGCGACGCTTTTTTTCTGGCAAGATA
GTCTTGTAAATGCGGGCCAAGATCTGCACACTGGTATTTCGGTT
TTTGGGGCCGCGGGCGGCGACGGGGCCCGTGCGTCCCAGCGCA
CATGTTCGGCGAGGCGGGGCCTGCGAGCGCGGCCACCGAGAAT
CGGACGGGGGTAGTCTCAAGCTGGCCGGCCTGCTCTGGTGCCT
GGCCTCGCGCCGCCGTGTATCGCCCCGCCCTGGGCGGCAAGGC
TGGCCCGGTCGGCACCAGTTGCGTGAGCGGAAAGATGGCCGCT
TCCCGGCCCTGCTGCAGGGAGCTCAAAATGGAGGACGCGGCGC
TCGGGAGAGCGGGCGGGTGAGTCACCCACACAAAGGAAAAGG
GCCTTTCCGTCCTCAGCCGTCGCTTCATGTGACTCCACGGAGTA
CCGGGCGCCGTCCAGGCACCTCGATTAGTTCTCGAGCTTTTGGA
GTACGTCGTCTTTAGGTTGGGGGAGGGGTTTTATGCGATGGA
GTTTCCCCACACTGAGTGGGTGGAGACTGAAGTTAGGCCAGCT |

TABLE 35-continued

Donor Template Nucleotide Sequences-Left Homology Arm to Right Homology Arm

| SEQ ID NO: | Description | Sequence |
|---|---|---|
| | | TGGCACTTGATGTAATTCTCCTTGGAATTTGCCCTTTTTGAGTTT<br>GGATCTTGGTTCATTCTCAAGCCTCAGACAGTGGTTCAAAGTTT<br>TTTTCTTCCATTTCAGGTGTCGTGACCACCATGGCGCTTCCGGT<br>GACAGCACTGCTCCTCCCCTTGGCGCTGTTGCTCCACGCAGCAA<br>GGCCGGATATAGTTATGACCCAATCACCCGATAGTCTTGCGGT<br>AAGCCTGGGGGAGCGAGCAACAATAAACTGTCGGGCATCAAA<br>ATCCGTCAGTACAAGCGGGTATTCATTCATGCACTGGTATCAA<br>CAGAAACCCGGTCAGCCACCCAAGCTCCTGATTTATCTTGCGTC<br>TAATCTTGAGTCCGGCGTCCCAGACCGGTTTTCCGGCTCCGGGA<br>GCGGCACGGATTTTACTCTTACTATTTCTAGCCTTCAGGCCGAA<br>GATGTGGCGGTATACTACTGCCAGCATTCAAGGGAAGTTCCTT<br>GGACGTTCGGTCAGGGCACGAAAGTGGAAATTAAAGGCGGGG<br>GGGGATCCGGCGGGGGAGGGTCTGGAGGAGGTGGCAGTGGTC<br>AGGTCCAACTGGTGCAGTCCGGGGCAGAGGTAAAAAAACCCG<br>GCGCGTCTGTTAAGGTTTCATGCAAGGCCAGTGGATATACTTTC<br>ACCAATTACGGAATGAACTGGGTGAGGCAGGCCCCTGGTCAAG<br>GCCTGAAATGGATGGGATGGATAAACACGTACACCGGTGAACC<br>TACCTATGCCGATGCCTTTAAGGGTCGGGTTACGATGACGAGA<br>GACACCTCCATATCAACAGCCTACATGGAGCTCAGCAGATTGA<br>GGAGTGACGATACGGCAGTCTATTACTGTGCAAGAGACTACGG<br>CGATTATGGCATGGATTACTGGGGCCAGGGCACTACAGTAACC<br>GTTTCCAGCAGTGCTGCTGCCTTTGTCCCGGTATTTCTCCCAGC<br>CAAACCGACCACGACTCCCGCCCCGCGCCCTCCGACACCCGCT<br>CCCACCATCGCCTCTCAACCTCTTAGTCTTCGCCCCGAGGCATG<br>CCGACCCGCCGCCGGGGGTGCTGTTCATACGAGGGGCTTGGAC<br>TTCGCTTGTGATATTTACATTTGGGCTCCGTTGGCGGGTACGTG<br>CGGCGTCCTTTTGTTGTCACTCGTTATTACTTTGTATTGTAATCA<br>CAGGAATCGCTCAAAGCGGAGTAGGTTGTTGCATTCCGATTAC<br>ATGAATATGACTCCTCGCCGGCCTGGGCCGACAAGAAAACATT<br>ACCAACCCTATGCCCCCCCACGAGACTTCGCTGCGTACAGGTC<br>CCGAGTGAAGTTTTCCCGAAGCGCAGACGCTCCGGCATATCAG<br>CAAGGACAGAATCAGCTGTATAACGAACTGAATTTGGGACGCC<br>GCGAGGAGTATGACGTGCTTGATAAACGCCGGGGAGAGACC<br>CGGAAATGGGGGGTAAACCCCGAAGAAAGAATCCCCAAGAAG<br>GACTCTACAATGAACTCCAGAAGGATAAGATGGCGGAGGCCTA<br>CTCAGAAATAGGTATGAAGGGCGAACGACGACGGGGAAAAGG<br>TCACGATGGCCTCTACCAAGGGTTGAGTACGGCAACCAAAGAT<br>ACGTACGATGCACTGCATATGCAGGCCCTGCCTCCCAGATAAT<br>AATAAAATCGCTATCCATCGAAGATGGATGTGTGTTGGTTTTTT<br>GTGTGTGGAGCAACAAATCTGACTTTGCATGTGCAAACGCCTT<br>CAACAACAGCATTATTCCAGAAGACACCTTCTTCCCCAGCCCA<br>GGTAAGGGCAGCTTTGGTGCCTTCGCAGGCTGTTTCCTTGCTTC<br>AGGAATGGCCAGGTTCTGCCCAGAGCTCTGGTCAATGATGTCT<br>AAAACTCCTCTGATTGGTGGTCTCGGCCTTATCCATTGCCACCA<br>AAACCCTCTTTTTACTAAGAAACAGTGAGCCTTGTTCTGGCAGT<br>CCAGAGAATGACACGGGAAAAAAGCAGATGAAGAGAAGGTGG<br>CAGGAGAGGGCACGTGGCCCAGCCTCAGTCTCTCCAACTGAGT<br>TCCTGCCTGCCTGCCTTTGCTCAGACTGTTTGCCCCTTACTGCTC<br>TTCTAGGCCTCATTCTAAGCCCCTTCTCCAAGTTGCCTCTCCTTA<br>TTTCTCCCTGTCTGCCAAAAAATCTTTCCCAGCTCACTAAGTCA<br>GTCTCACGCAGTCACTCATTAACCCACCAATCACTGATTGTGCC<br>GGCACATGAATGCACCAGGTGTTGAAGTGGAGGAATTAAAAA<br>GTCAGATGAGGGGTGTGCCCAGAGGAAGCACCATTCTAGTTGG<br>GGGAGCCCATCTGTCAGCTGGGAAAAGTCCAAATAACTTCAGA<br>TTGGAATGTGTTTTAACTCAGGGTTGAGAAAACAGCTACCTTC<br>AGGACAAAAGTCAGGGAAGGGCTCTCTGAAGAAATGCTACTTG<br>AAGATACCAGCCCTACCAAGGGCAGGGAGAGGACCCTATAGA<br>GGCCTGGGACAGGAGCTCAATGAGAAAGG |
| 1395 | LHA to RHA of CTX-145 | GAGATGTAAGGAGCTGCTGTGACTTGCTCAAGGCCTTATATCG<br>AGTAAACGGTAGTGCTGGGGCTTAGACGCAGGTGTTCTGATTT<br>ATAGTTCAAAACCTCTATCAATGAGAGAGCAATCTCCTGGTAA<br>TGTGATAGATTTCCCAACTTAATGCCAACATACCATAAACCTCC<br>CATTCTGCTAATGCCCAGCCTAAGTTGGGGAGACCACTCCAGA<br>TTCCAAGATGTACAGTTTGCTTTGCTGGGCCTTTTTCCCATGCC<br>TGCCTTTACTCTGCCAGAGTTATATTGCTGGGGTTTTGAAGAAG<br>ATCCTATTAAATAAAAGAATAAGCAGTATTATTAAGTAGCCCT<br>GCATTTCAGGTTTCCTTGAGTGGCAGGCCAGGCCTGGCCGTGA<br>ACGTTCACTGAAATCATGGCCTCTTGGCCAAGATTGATAGCTTG<br>TGCCTGTCCCTGAGTCCCAGTCCATCACGAGCAGCTGGTTCTA<br>AGATGCTATTTCCCGTATAAAGCATGAGACCGTGACTTGCCAG<br>CCCCACAGAGCCCCGCCCTTGTCCATCACTGGCATCTGGACTCC<br>AGCCTGGGTTGGGCAAAGAGGGAAATGAGATCATGTCCTAAC<br>CCTGATCCTCTTGTCCCACAGATATCCAGAACCCTGACCCTGCC<br>GTGTACCAGCTGAGAGACTCTAAATCCAGTGACAAGTCTGTCT |

TABLE 35-continued

Donor Template Nucleotide Sequences-Left Homology Arm to Right Homology Arm

| SEQ ID NO: | Description | Sequence |
|---|---|---|
| | | GCCTATTCACCGATTTTGATTCTCAAACAAATGTGTCACAAAGT
AAGGATTCTGATGTGTATATCACAGACAAAACTGTGCTAGACA
TGAGGTCTATGGACTTCAGGCTCCGGTGCCCGTCAGTGGGCAG
AGCGCACATCGCCCACAGTCCCCGAGAAGTTGGGGGGAGGGG
TCGGCAATTGAACCGGTGCCTAGAGAAGGTGGCGCGGGGTAA
ACTGGGAAAGTGATGTCGTGTACTGGCTCCGCCTTTTTCCCGAG
GGTGGGGGAGAACCGTATATAAGTGCAGTAGTCGCCGTGAACG
TTCTTTTTCGCAACGGGTTTGCCGCCAGAACACAGGTAAGTGCC
GTGTGTGGTTCCCGCGGGCCTGGCCTCTTTACGGGTTATGGCCC
TTGCGTGCCTTGAATTACTTCCACTGGCTGCAGTACGTGATTCT
TGATCCCGAGCTTCGGGTTGGAAGTGGGTGGGAGAGTTCGAGG
CCTTGCGCTTAAGGAGCCCCTTCGCCTCGTGCTTGAGTTGAGGC
CTGGCCTGGGCGCTGGGGCCGCCGCGTGCGAATCTGGTGGCAC
CTTCGCGCCTGTCTCGCTGCTTTCGATAAGTCTCTAGCCATTTA
AAATTTTTGATGACCTGCTGCGACGCTTTTTTTCTGGCAAGATA
GTCTTGTAAATGCGGGCCAAGATCTGCACACTGGTATTTCGGTT
TTTGGGGCCGCGGGCGGCGACGGGGCCCGTGCGTCCCAGCGCA
CATGTTCGGCGAGGCGGGGCCTGCGAGCGCGGCCACCGAGAAT
CGGACGGGGGTAGTCTCAAGCTGGCCGGCCTGCTCTGGTGCCT
GGCCTCGCGCCGCCGTGTATCGCCCCGCCCTGGGCGGCAAGGC
TGGGCCCGGTCGGCACCAGTTGCGTGAGCGGAAAGATGGCCGCT
TCCCGGCCCTGCTGCAGGGAGCTCAAAATGGAGGACGCGGCGC
TCGGGAGAGCGGGCGGGTGAGTCACCCACACAAAGGAAAAGG
GCCTTTCCGTCCTCAGCCGTCGCTTCATGTGACTCCACGGAGTA
CCGGGCGCCGTCCAGGCACCTCGATTAGTTCTCGAGCTTTTGGA
GTACGTCGTCTTTAGGTTGGGGGGAGGGGTTTTATGCGATGGA
GTTTCCCCACACTGAGTGGGTGGAGACTGAAGTTAGGCCAGCT
TGGCACTTGATGTAATTCTCCTTGGAATTTGCCCTTTTTGAGTTT
GGATCTTGGTTCATTCTCAAGCCTCAGACAGTGGTTCAAAGTTT
TTTTCTTCCATTTCAGGTGTCGTGACCACCATGGCGCTTCCGGT
GACAGCACTGCTCCTCCCCTTGGCGCTGTTGCTCCACGCAGCAA
GGCCGCAGGTCCAGTTGGTGCAAAGCGGGGCGGAGGTGAAAA
AACCCGGCGCTTCCGTGAAGGTGTCCTGTAAGGCGTCCGGTTA
TACGTTCACGAACTACGGGATGAATTGGGTTCGCCAAGCGCCG
GGGCAGGGACTGAAATGGATGGGGTGGATAAATACCTACACC
GGCGAACCTACATACGCCGACGCTTTTAAAGGGCGAGTCACTA
TGACGCGCGATACCAGCATATCCACCGCATACATGGAGCTGTC
CCGACTCCGGTCAGACGACACGGCTGTCTACTATTGTGCTCGG
GACTATGGCGATTATGGCATGGACTACTGGGGTCAGGGTACGA
CTGTAACAGTTAGTAGTGGTGGAGGCGGCAGTGGCGGGGGGG
GAAGCGGAGGAGGGGGTTCTGGTGACATAGTTATGACCCAATC
CCCAGATAGTTTGGCGGTTTCTCTGGGCGAGAGGGCAACGATT
AATTGTCGCGCATCAAAGAGCGTTTCAACGAGCGGATATTCTT
TTATGCATTGGTACCAGCAAAAACCCGGACAACCGCCGAAGCT
GCTGATCTACTTGGCTTCAAATCTTGAGTCTGGGGTGCCGGACC
GATTTTCTGGTAGTGGAAGCGGAACTGACTTTACGCTCACGAT
CAGTTCACTGCAGGCTGAGGATGTAGCGGTCTATTATTGCCAG
CACAGTAGAGAAGTCCCCTGGACCTTCGGTCAAGGCACGAAAG
TAGAAATTAAAAGTGCTGCTGCCTTTGTCCCGGTATTTCTCCCA
GCCAAACCGACCACGACTCCCGCCCCGCGCCCTCCGACACCCG
CTCCCACCATCGCCTCTCAACCTCTTAGTCTTCGCCCCGAGGCA
TGCCGACCCGCCGCCGGGGGTGCTGTTCATACGAGGGGCTTGG
ACTTCGCTTGTGATATTTACATTTGGGCTCCGTTGGCGGGTACG
TGCGGCGTCCTTTTGTTGTCACTCGTTATTACTTTGTATTGTAAT
CACAGGAATCGCTCAAAGCGGAGTAGGTTGTTGCATTCCGATT
ACATGAATATGACTCCTCGCCGGCCTGGCCGACAAGAAAACA
TTACCAACCCTATGCCCCCCCACGAGACTTCGCTGCGTACAGGT
CCCGAGTGAAGTTTTCCCGAAGCGCAGACGCTCCGGCATATCA
GCAAGGACAGAATCAGCTGTATAACGAACTGAATTTGGGACGC
CGCGAGGAGTATGACGTGCTTGATAAACGCCGGGGAGAGAC
CCGGAAATGGGGGTAAACCCCGAAGAAAGAATCCCCAAGAA
GGACTCTACAATGAACTCCAGAAGGATAAGATGGCGGAGGCCT
ACTCAGAAATAGGTATGAAGGGCGAACGACGACGGGGAAAAG
GTCACGATGGCCTCTACCAAGGGTTGAGTACGGCAACCAAAGA
TACGTACGATGCACTGCATATGCAGGCCCTGCCTCCCAGATAA
TAATAAAATCGCTATCCATCGAAGATGGATGTGTGTTGGTTTTT
TGTGTGTGGAGCAACAAATCTGACTTTGCATGTGCAAACGCCT
TCAACAACAGCATTATTCCAGAAGACACCTTCTTCCCCAGCCC
AGGTAAGGGCAGCTTTGGTGCCTTCGCAGGCTGTTTCCTTGCTT
CAGGAATGGCCAGGTTCTGCCCAGAGCTCTGGTCAATGATGTC
TAAAACTCCTCTGATTGGTGGTCTCGGCCTTATCCATTGCCACC
AAAACCCTCTTTTTACTAAGAAACAGTGAGCCTTGTTCTGGCAG
TCCAGAGAATGACACGGGAAAAAAGCAGATGAAGAGAAGGTG
GCAGGAGAGGGCACGTGGCCCAGCCTCAGTCTCTCCAACTGAG
TTCCTGCCTGCCTGCCTTTGCTCAGACTGTTTGCCCCTTACTGCT |

TABLE 35-continued

Donor Template Nucleotide Sequences-Left Homology Arm to Right Homology Arm

| SEQ ID NO: | Description | Sequence |
|---|---|---|
| | | CTTCTAGGCCTCATTCTAAGCCCCTTCTCCAAGTTGCCTCTCCTT<br>ATTTCTCCCTGTCTGCCAAAAAATCTTTCCCAGCTCACTAAGTC<br>AGTCTCACGCAGTCACTCATTAACCCACCAATCACTGATTGTGC<br>CGGCACATGAATGCACCAGGTGTTGAAGTGGAGGAATTAAAA<br>AGTCAGATGAGGGGTGTGCCCAGAGGAAGCACCATTCTAGTTG<br>GGGGAGCCCATCTGTCAGCTGGGAAAAGTCCAAATAACTTCAG<br>ATTGGAATGTGTTTTAACTCAGGGTTGAGAAAACAGCTACCTT<br>CAGGACAAAAGTCAGGGAAGGGCTCTCTGAAGAAATGCTACTT<br>GAAGATACCAGCCCTACCAAGGGCAGGGAGAGGACCCTATAG<br>AGGCCTGGGACAGGAGCTCAATGAGAAAGG |
| 1396 | LHA to RHA of CTX-145b | GAGATGTAAGGAGCTGCTGTGACTTGCTCAAGGCCTTATATCG<br>AGTAAACGGTAGTGCTGGGGCTTAGACGCAGGTGTTCTGATTT<br>ATAGTTCAAAACCTCTATCAATGAGAGCAATCTCCTGGTAA<br>TGTGATAGATTTCCCAACTTAATGCCAACATACCATAAACCTCC<br>CATTCTGCTAATGCCCAGCCTAAGTTGGGGAGACCACTCCAGA<br>TTCCAAGATGTACAGTTTGCTTTGCTGGGCCTTTTTCCCATGCC<br>TGCCTTTACTCTGCCAGAGTTATATTGCTGGGGTTTTGAAGAAG<br>ATCCTATTAAATAAAAGAATAAGCAGTATTATTAAGTAGCCCT<br>GCATTTCAGGTTTCCTTGAGTGGCAGGCCAGGCCTGGCCGTGA<br>ACGTTCACTGAAATCATGGCCTCTTGGCCAAGATTGATAGCTTG<br>TGCCTGTCCCTGAGTCCCAGTCCATCACGAGCAGCTGGTTTCTA<br>AGATGCTATTTCCCGTATAAAGCATGAGACCGTGACTTGCCAG<br>CCCCACAGAGCCCCGCCCTTGTCCATCACTGGCATCTGGACTCC<br>AGCCTGGGTTGGGGCAAAGAGGGAAATGAGATCATGTCCTAAC<br>CCTGATCCTCTTGTCCCACAGATATCCAGAACCCTGACCCTGCC<br>GTGTACCAGCTGAGAGACTCTAAATCCAGTGACAAGTCTGTCT<br>GCCTATTCACCGATTTTGATTCTCAAACAAATGTGTCACAAAGT<br>AAGGATTCTGATGTGTATATCACAGACAAAACTGTGCTAGACA<br>TGAGGTCTATGGACTTCAGGCTCCGGTGCCCGTCAGTGGGCAG<br>AGCGCACATCGCCCACAGTCCCCGAGAAGTTGGGGGGAGGGG<br>TCGGCAATTGAACCGGTGCCTAGAGAAGGTGGCGCGGGGTAA<br>ACTGGGAAAGTGATGTCGTGTACTGGCTCCGCCTTTTTCCCGAG<br>GGTGGGGGAGAACCGTATATAAGTGCAGTAGTCGCCGTGAACG<br>TTCTTTTTCGCAACGGGTTTGCCGCCAGAACACAGGTAAGTGCC<br>GTGTGTGGTTCCCGCGGGCCTGGCCTCTTTACGGGTTATGGCCC<br>TTGCGTGCCTTGAATTACTTCCACTGGCTGCAGTACGTGATTCT<br>TGATCCCGAGCTTCGGGTTGGAAGTGGGTGGGAGAGTTCGAGG<br>CCTTGCGCTTAAGGAGCCCCTTCGCCTCGTGCTTGAGTTGAGGC<br>CTGGCCTGGGCGCTGGGGCCGCCGCGTGCGAATCTGGTGGCAC<br>CTTCGCGCCTGTCTCGCTGCTTTCGATAAGTCTCTAGCCATTTA<br>AAATTTTTGATGACCTGCTGCGACGCTTTTTTTCTGGCAAGATA<br>GTCTTGTAAATGCGGGCCAAGATCTGCACACTGGTATTTCGGTT<br>TTTGGGGCCGCGGGCGGCGACGGGGCCCGTGCGTCCCAGCGCA<br>CATGTTCGGCGAGGCGGGGCCTGCGAGCGCGGCCACCGAGAAT<br>CGGACGGGGGTAGTCTCAAGCTGGCCGGCCTGCTCTGGTGCCT<br>GGCCTCGCGCCGCCGTGTATCGCCCCGCCCTGGGCGGCAAGGC<br>TGGCCCGGTCGGCACCAGTTGCGTGAGCGGAAAGATGGCCGCT<br>TCCCGGCCCTGCTGCAGGGAGCTCAAAATGGAGGACGCGGCGC<br>TCGGGAGAGCGGGCGGGTGAGTCACCCACACAAAGGAAAAGG<br>GCCTTTCCGTCCTCAGCCGTCGCTTCATGTGACTCCACGGAGTA<br>CCGGGCGCCGTCCAGGCACCTCGATTAGTTCTCGAGCTTTTGGA<br>GTACGTCGTCTTTAGGTTGGGGGGAGGGGTTTTATGCGATGGA<br>GTTTCCCCACACTGAGTGGGTGGAGACTGAAGTTAGGCCAGCT<br>TGGCACTTGATGTAATTCTCCTTGGAATTTGCCCTTTTTGAGTTT<br>GGATCTTGGTTCATTCTCAAGCCTCAGACAGTGGTTCAAAGTTT<br>TTTTCTTCCATTTCAGGTGTCGTGACCACCATGGCGCTTCCGGT<br>GACAGCACTGCTCCTCCCCTTGGCGCTGTTGCTCCACGCAGCAA<br>GGCCGCAGGTCCAGTTGGTGCAAAGCGGGGCGGAGGTGAAAA<br>AACCCGGCGCTTCCGTGAAGGTGTCCTGTAAGGCGTCCGGTTA<br>TACGTTCACGAACTACGGGATGAATTGGGTTCGCCAAGCGCCG<br>GGGCAGGGACTGAAATGGATGGGGTGGATAAATACCTACACC<br>GGCGAACCTACATACGCCGACGCTTTTAAAGGGCGAGTCACTA<br>TGACGCGCGATACCAGCATATCCACCGCATACATGGAGCTGTC<br>CCGACTCCGGTCAGACGACACGGCTGTCTACTATTGTGCTCGG<br>GACTATGGCGATTATGGCATGGACTACTGGGGTCAGGGTACGA<br>CTGTAACAGTTAGTAGTGGTGGAGGCGGCAGTGGCGGGGGGG<br>GAAGCGGAGGAGGGGGTTCTGGTGACATAGTTATGACCCAATC<br>CCCAGATAGTTTGGCGGTTTCTCTGGGCGAGAGGGCAACGATT<br>AATTGTCGCGCATCAAAGAGCGTTTCAACGAGCGGATATTCTT<br>TTATGCATTGGTACCAGCAAAAACCCGGACAACCGCCGAAGCT<br>GCTGATCTACTTGGCTTCAAATCTTGAGTCTGGGGTGCCGGACC<br>GATTTTCTGGTAGTGGAAGCGGAACTGACTTTACGCTCACGAT<br>CAGTTCACTGCAGGCTGAGGATGTAGCGGTCTATTATTGCCAG<br>CACAGTAGAGAAGTCCCCTGGACCTTCGGTCAAGGCACGAAAG |

TABLE 35-continued

Donor Template Nucleotide Sequences-Left Homology Arm to Right Homology Arm

| SEQ ID NO: | Description | Sequence |
|---|---|---|
| | | TAGAAATTAAAAGTGCTGCTGCCTTTGTCCCGGTATTTCTCCCA
GCCAAACCGACCACGACTCCCGCCCCGCGCCCTCCGACACCCG
CTCCCACCATCGCCTCTCAACCTCTTAGTCTTCGCCCCGAGGCA
TGCCGACCCGCCGCCGGGGGTGCTGTTCATACGAGGGGCTTGG
ACTTCGCTTGTGATATTTACATTTGGGCTCCGTTGGCGGGTACG
TGCGGCGTCCTTTTGTTGTCACTCGTTATTACTTTGTATTGTAAT
CACAGGAATCGCAAACGGGGCAGAAAGAAACTCCTGTATATAT
TCAAACAACCATTTATGAGACCAGTACAAACTACTCAAGAGGA
AGATGGCTGTAGCTGCCGATTTCCAGAAGAAGAAGAAGGAGG
ATGTGAACTGCGAGTGAAGTTTTCCCGAAGCGCAGACGCTCCG
GCATATCAGCAAGGACAGAATCAGCTGTATAACGAACTGAATT
TGGGACGCCGCGAGGAGTATGACGTGCTTGATAAACGCCGGGG
GAGAGACCCGGAAATGGGGGGTAAACCCCGAAGAAAGAATCC
CCAAGAAGGACTCTACAATGAACTCCAGAAGGATAAGATGGC
GGAGGCCTACTCAGAAATAGGTATGAAGGGCGAACGACGACG
GGGAAAAGGTCACGATGGCCTCTACCAAGGGTTGAGTACGGCA
ACCAAAGATACGTACGATGCACTGCATATGCAGGCCCTGCCTC
CCAGATAATAATAAAATCGCTATCCATCGAAGATGGATGTGTG
TTGGTTTTTTGTGTGTGGAGCAACAAATCTGACTTTGCATGTGC
AAACGCCTTCAACAACAGCATTATTCCAGAAGACACCTTCTTC
CCCAGCCCAGGTAAGGGCAGCTTTGGTGCCTTCGCAGGCTGTT
TCCTTGCTTCAGGAATGGCCAGGTTCTGCCCAGAGCTCTGGTCA
ATGATGTCTAAAACTCCTCTGATTGGTGGTCTCGGCCTTATCCA
TTGCCACCAAAACCCTCTTTTTACTAAGAAACAGTGAGCTTGT
TCTGGCAGTCCAGAGAATGACACGGGAAAAAAGCAGATGAAG
AGAAGGTGGCAGGAGAGGGCACGTGGCCCAGCCTCAGTCTCTC
CAACTGAGTTCCTGCCTGCCTGCCTTTGCTCAGACTGTTTGCCC
CTTACTGCTCTTCTAGGCCTCATTCTAAGCCCCTTCTCCAAGTT
GCCTCTCCTTATTTCTCCCTGTCTGCCAAAAAATCTTTCCCAGCT
CACTAAGTCAGTCTCACGCAGTCACTCATTAACCCACCAATCA
CTGATTGTGCCGGCACATGAATGCACCAGGTGTTGAAGTGGAG
GAATTAAAAAGTCAGATGAGGGGTGTGCCCAGAGGAAGCACC
ATTCTAGTTGGGGGAGCCCATCTGTCAGCTGGGAAAAGTCCAA
ATAACTTCAGATTGGAATGTGTTTTAACTCAGGGTTGAGAAAA
CAGCTACCTTCAGGACAAAAGTCAGGGAAGGGCTCTCTGAAGA
AATGCTACTTGAAGATACCAGCCCTACCAAGGGCAGGGAGAG
GACCCTATAGAGGCCTGGGACAGGAGCTCAATGAGAAAGG |
| 1397 | LHA to RHA of CTX-152 | GAAGATCCTATTAAATAAAAGAATAAGCAGTATTATTAAGTAG
CCCTGCATTTCAGGTTTCCTTGAGTGGCAGGCCAGGCCTGGCCG
TGAACGTTCACTGAAATCATGGCCTCTTGGCCAAGATTGATAG
CTTGTGCCTGTCCCTGAGTCCCAGTCCATCACGAGCAGCTGGTT
TCTAAGATGCTATTTCCCGTATAAAGCATGAGACCGTGACTTGC
CAGCCCCACAGAGCCCCGCCCTTGTCCATCACTGGCATCTGGA
CTCCAGCCTGGGTTGGGGCAAAGAGGGAAATGAGATCATGTCC
TAACCCTGATCCTCTTGTCCCACAGATATCCAGAACCCTGACCC
TGCCGTGTACCAGCTGAGAGACTCTAAATCCAGTGACAAGTCT
GTCTGCCTATTCACCGATTTTGATTCTCAAACAAATGTGTCACA
AAGTAAGGATTCTGATGTGTATATCACAGACAAAACTGTGCTA
GACATGAGGTCTATGGACTTCAGGCTCCGGTGCCCGTCAGTGG
GCAGAGCGCACATCGCCCACAGTCCCCGAGAAGTTGGGGGGA
GGGGTCGGCAATTGAACCGGTGCCTAGAGAAGGTGGCGCGGG
GTAAACTGGGAAAGTGATGTCGTGTACTGGCTCCGCCTTTTTCC
CGAGGGTGGGGAGAACCGTATATAAGTGCAGTAGTCGCCGTG
AACGTTCTTTTTCGCAACGGGTTTGCCGCCAGAACACAGGTAA
GTGCCGTGTGTGGTTCCCGCGGGCCTGGCCTCTTTACGGGTTAT
GGCCCTTGCGTGCCTTGAATTACTTCCACTGGCTGCAGTACGTG
ATTCTTGATCCCGAGCTTCGGGTTGGAAGTGGGTGGGAGAGTT
CGAGGCCTTGCGCTTAAGGAGCCCCTTCGCCTCGTGCTTGAGTT
GAGGCCTGGCCTGGGCGCTGGGGCCGCCGCGTGCGAATCTGGT
GGCACCTTCGCGCCTGTCTCGCTGCTTTCGATAAGTCTCTAGCC
ATTTAAAATTTTTGATGACCTGCTGCGACAGCTTTTTTTCTGGCA
AGATAGTCTTGTAAATGCGGGCCAAGATCTGCACACTGGTATT
TCGGTTTTTGGGGCCGCGGGCGGCGACGGGCCCGTGCGTCCC
AGCGCACATGTTCGGCGAGGCGGGCCTGCGAGCGCGGCCACC
GAGAATCGGACGGGGGTAGTCTCAAGCTGGCCGGCCTGCTCTG
GTGCCTGGCCTCGCGCCGCCGTGTATCGCCCCGCCCTGGGCGG
CAAGGCTGGCCCGGTCGGCACCAGTTGCGTGAGCGGAAAGATG
GCCGCTTCCCGGCCCTGCTGCAGGGAGCTCAAAATGGAGGACG
CGGCGCTCGGGAGAGCGGGCGGGTGAGTCACCCACACAAAGG
AAAAGGGCCTTTCCGTCCTCAGCCGTCGCTTCATGTGACTCCAC
GGAGTACCGGGCGCCGTCCAGGCACCTCGATTAGTTCTCGAGC
TTTTGGAGTACGTCGTCTTTAGGTTGGGGGGAGGGGTTTTATGC
GATGGAGTTTCCCCACACTGAGTGGGTGGAGACTGAAGTTAGG
CCAGCTTGGCACTTGATGTAATTCTCCTTGGAATTTGCCCTTTTT |

TABLE 35-continued

Donor Template Nucleotide Sequences-Left Homology Arm to Right Homology Arm

| SEQ ID NO: | Description | Sequence |
|---|---|---|
| | | GAGTTTGGATCTTGGTTCATTCTCAAGCCTCAGACAGTGGTTCA
AAGTTTTTTTCTTCCATTTCAGGTGTCGTGACCACCATGGCTCTT
CCTGTAACCGCACTTCTGCTTCCTCTTGCTCTGCTGCTTCATGCT
GCTAGACCTCAGGTGCAGTTACAACAGTCAGGAGGAGGATTAG
TGCAGCCAGGAGGATCTCTGAAACTGTCTTGTGCCGCCAGCGG
AATCGATTTTAGCAGGTACTGGATGTCTTGGGTGAGAAGAGCC
CCTGGAAAAGGACTGGAGTGGATCGGCGAGATTAATCCTGATA
GCAGCACCATCAACTATGCCCCTAGCCTGAAGGACAAGTTCAT
CATCAGCCGGGACAATGCCAAGAACACCCTGTACCTGCAAATG
AGCAAGGTGAGGAGCGAGGATACAGCTCTGTACTACTGTGCCA
GCCTGTACTACGATTACGGAGATGCTATGGACTATTGGGGCCA
GGGAACAAGCGTTACAGTGTCTTCTGGAGGAGGAGGATCCGGT
GGTGGTGGTTCAGGAGGTGGAGGTTCGGGAGATATTGTGATGA
CACAAAGCCAGCGGTTCATGACCACATCTGTGGGCGACAGAGT
GAGCGTGACCTGTAAAGCTTCTCAGTCTGTGGACAGCAATGTT
GCCTGGTATCAGCAGAAGCCCAGACAGAGCCCTAAAGCCCTGA
TCTTTTCTGCCAGCCTGAGATTTTCTGGCGTTCCTGCCAGATTT
ACCGGCTCTGGCTCTGGCACCGATTTTACACTGACCATCAGCA
ATCTGCAGTCTGAGGATCTGGCCGAGTACTTTTGCCAGCAGTA
CAACAACTACCCCCTGACCTTTGGAGCTGGCACAAAACTGGAG
CTGAAGAGTGCTGCTGCCTTTGTCCCGGTATTTCTCCCAGCCAA
ACCGACCACGACTCCCGCCCCGCGCCCTCCGACACCCGCTCCC
ACCATCGCCTCTCAACCTCTTAGTCTTCGCCCCGAGGCATGCCG
ACCCGCCGCCGGGGGTGCTGTTCATACGAGGGGCTTGGACTTC
GCTTGTGATATTTACATTTGGGCTCCGTTGGCGGGTACGTGCGG
CGTCCTTTTGTTGTCACTCGTTATTACTTTGTATTGTAATCACAG
GAATCGCTCAAAGCGGAGTAGGTTGTTGCATTCCGATTACATG
AATATGACTCCTCGCCGGCCTGGGCCGACAAGAAAACATTACC
AACCCTATGCCCCCCCACGAGACTTCGCTGCGTACAGGTCCCG
AGTGAAGTTTTCCCGAAGCGCAGACGCTCCGGCATATCAGCAA
GGACAGAATCAGCTGTATAACGAACTGAATTTGGGACGCCGCG
AGGAGTATGACGTGCTTGATAAACGCCGGGGAGAGACCCGG
AAATGGGGGTAAACCCCGAAGAAAGAATCCCCAAGAAGGAC
TCTACAATGAACTCCAGAAGGATAAGATGGCGGAGGCCTACTC
AGAAATAGGTATGAAGGGCGAACGACGACGGGGAAAAGGTCA
CGATGGCCTCTACCAAGGGTTGAGTACGGCAACCAAAGATACG
TACGATGCACTGCATATGCAGGCCCTGCCTCCCAGAGGAAGCG
GAGCTACTAACTTCAGCCTGCTGAAGCAGGCTGGAGACGTGGA
GGAGAACCCTGGACCTATGGTGAGCAAGGGCGAGGAGCTGTTC
ACCGGGGTGGTGCCCATCCTGGTCGAGCTGGACGGCGACGTAA
ACGGCCACAAGTTCAGCGTGTCCGGCGAGGGCGAGGGCGATG
CCACCTACGGCAAGCTGACCCTGAAGTTCATCTGCACCACCGG
CAAGCTGCCCGTGCCCTGGCCCACCCTCGTGACCACCCTGACCT
ACGGCGTGCAGTGCTTCAGCCGCTACCCCGACCACATGAAGCA
GCACGACTTCTTCAAGTCCGCCATGCCCGAAGGCTACGTCCAG
GAGCGCACCATCTTCTTCAAGGACGACGGCAACTACAAGACCC
GCGCCGAGGTGAAGTTCGAGGGCGACACCCTGGTGAACCGCAT
CGAGCTGAAGGGCATCGACTTCAAGGAGGACGGCAACATCCTG
GGGCACAAGCTGGAGTACAACTACAACAGCCACAACGTCTATA
TCATGGCCGACAAGCAGAAGAACGGCATCAAGGTGAACTTCA
AGATCCGCCACAACATCGAGGACGGCAGCGTGCAGCTCGCCGA
CCACTACCAGCAGAACACCCCCATCGGCGACGGCCCCGTGCTG
CTGCCCGACAACCACTACCTGAGCACCCAGTCCGCCCTGAGCA
AAGACCCCAACGAGAAGCGCGATCACATGGTCCTGCTGGAGTT
CGTGACCGCCGCCGGGATCACTCTCGGCATGGACGAGCTGTAC
AAGTAATAATAAAATAAAATCGCTATCCATCGAAGATGGATGT
GTGTTGGTTTTTTGTGTGTGGAGCAACAAATCTGACTTTGCATG
TGCAAACGCCTTCAACAACAGCATTATTCCAGAAGACACCTTC
TTCCCCAGCCCAGGTAAGGGCAGCTTTGGTGCCTTCGCAGGCT
GTTTCCTTGCTTCAGGAATGGCCAGGTTCTGCCCAGAGCTCTGG
TCAATGATGTCTAAAACTCCTCTGATTGGTGGTCTCGGCCTTAT
CCATTGCCACCAAAACCCTCTTTTTACTAAGAAACAGTGAGCCT
TGTTCTGGCAGTCCAGAGAATGACACGGGAAAAAAGCAGATG
AAGAGAAGGTGGCAGGAGAGGGCACGTGCCCAGCCTCAGTC
TCTCCAACTGAGTTCCTGCCTGCCTGCCTTTGCTCAGACTGTTT
GCCCCTTACTGCTCTTCTAGGCCTCATTCTAAGCCCCTTCTCCA
AGTTGCCTCTCCTTATTTCTCCCTGTCTGCCAAAAAATCTTTCCC
AGCTCACTAAGTCAGTCTCACGCAGTCACTCATTAACCC |
| 1398 | LHA to RHA of
CTX-153 | GAGATGTAAGGAGCTGCTGTGACTTGCTCAAGGCCTTATATCG
AGTAAACGGTAGTGCTGGGGCTTAGACGCAGGTGTTCTGATTT
ATAGTTCAAAACCTCTATCAATGAGAGAGCAATCTCCTGGTAA
TGTGATAGATTTCCCAACTTAATGCCAACATACCATAAACCTCC
CATTCTGCTAATGCCCAGCCTAAGTTGGGGAGACCACTCCAGA
TTCCAAGATGTACAGTTTGCTTTGCTGGGCCTTTTTCCCATGCC |

TABLE 35-continued

Donor Template Nucleotide Sequences-Left Homology Arm to Right Homology Arm

| SEQ ID NO: | Description | Sequence |
|---|---|---|
| | | TGCCTTTACTCTGCCAGAGTTATATTGCTGGGGTTTTGAAGAAG
ATCCTATTAAATAAAAGAATAAGCAGTATTATTAAGTAGCCCT
GCATTTCAGGTTTCCTTGAGTGGCAGGCCAGGCCTGGCCGTGA
ACGTTCACTGAAATCATGGCCTCTTGGCCAAGATTGATAGCTTG
TGCCTGTCCCTGAGTCCCAGTCCATCACGAGCAGCTGGTTTCTA
AGATGCTATTTCCCGTATAAAGCATGAGACCGTGACTTGCCAG
CCCCACAGAGCCCCGCCCTTGTCCATCACTGGCATCTGGACTCC
AGCCTGGGTTGGGGCAAAGAGGGAAATGAGATCATGTCCTAAC
CCTGATCCTCTTGTCCCACAGATATCCAGAACCCTGACCCTGCC
GTGTACCAGCTGAGAGACTCTAAATCCAGTGACAAGTCTGTCT
GCCTATTCACCGATTTTGATTCTCAAACAAATGTGTCACAAAGT
AAGGATTCTGATGTGTATATCACAGACAAAACTGTGCTAGACA
TGAGGTCTATGGACTTCAGGCTCCGGTGCCCGTCAGTGGGCAG
AGCGCACATCGCCCACAGTCCCCGAGAAGTTGGGGGGAGGGG
TCGGCAATTGAACCGGTGCCTAGAGAAGGTGGCGCGGGGTAA
ACTGGGAAAGTGATGTCGTGTACTGGCTCCGCCTTTTTCCCGAG
GGTGGGGGAGAACCGTATATAAGTGCAGTAGTCGCCGTGAACG
TTCTTTTTCGCAACGGGTTTGCCGCCAGAACACAGGTAAGTGCC
GTGTGTGGTTCCCGCGGGCCTGGCCTCTTTACGGGTTATGGCCC
TTGCGTGCCTTGAATTACTTCCACTGGCTGCAGTACGTGATTCT
TGATCCCGAGCTTCGGGTTGGAAGTGGGTGGGAGAGTTCGAGG
CCTTGCGCTTAAGGAGCCCCTTCGCCTCGTGCTTGAGTTGAGGC
CTGGCCTGGGCGCTGGGGCCGCCGCGTGCGAATCTGGTGGCAC
CTTCGCGCCTGTCTCGCTGCTTTCGATAAGTCTCTAGCCATTTA
AAATTTTTGATGACCTGCTGCGACGCTTTTTTTCTGGCAAGATA
GTCTTGTAAATGCGGGCCAAGATCTGCACACTGGTATTTCGGTT
TTTGGGGCCGCGGGCGGCGACGGGGCCCGTGCGTCCCAGCGCA
CATGTTCGGCGAGGCGGGGCCTGCGAGCGCGGCCACCGAGAAT
CGGACGGGGGTAGTCTCAAGCTGGCCGGCCTGCTCTGGTGCCT
GGCCTCGCGCCGCCGTGTATCGCCCCGCCCTGGGCGGCAAGGC
TGGCCCGGTCGGCACCAGTTGCGTGAGCGGAAAGATGGCCGCT
TCCCGGCCCTGCTGCAGGGAGCTCAAAATGGAGGACGCGGCGC
TCGGGAGAGCGGGCGGGTGAGTCACCCACACAAAGGAAAAGG
GCCTTTCCGTCCTCAGCCGTCGCTTCATGTGACTCCACGGAGTA
CCGGGCGCCGTCCAGGCACCTCGATTAGTTCTCGAGCTTTTGGA
GTACGTCGTCTTTAGGTTGGGGGGAGGGGTTTTATGCGATGGA
GTTTCCCCACACTGAGTGGGTGGAGACTGAAGTTAGGCCAGCT
TGGCACTTGATGTAATTCTCCTTGGAATTTGCCCTTTTTGAGTTT
GGATCTTGGTTCATTCTCAAGCCTCAGACAGTGGTTCAAAGTTT
TTTTCTTCCATTTCAGGTGTCGTGACCACCATGGCTCTTCCTGTA
ACCGCACTTCTGCTTCCTCTTGCTCTGCTGCTTCATGCTGCTAG
ACCTCAGGTGCAGTTACAACAGTCAGGAGGAGGATTAGTGCAG
CCAGGAGGATCTCTGAAACTGTCTTGTGCCGCCAGCGGAATCG
ATTTTAGCAGGTACTGGATGTCTTGGGTGAGAAGAGCCCCTGG
AAAAGGACTGGAGTGGATCGGCGAGATTAATCCTGATAGCAGC
ACCATCAACTATGCCCCTAGCCTGAAGGACAAGTTCATCATCA
GCCGGGACAATGCCAAGAACACCCTGTACCTGCAAATGAGCAA
GGTGAGGAGCGAGGATACAGCTCTGTACTACTGTGCCAGCCTG
TACTACGATTACGGAGATGCTATGGACTATTGGGGCCAGGGAA
CAAGCGTTACAGTGTCTTCTGGAGGAGGAGGATCCGGTGGTGG
TGGTTCAGGAGGTGGAGGTTCGGGAGATATTGTGATGACACAA
AGCCAGCGGTTCATGACCACATCTGTGGGCGACAGAGTGAGCG
TGACCTGTAAAGCTTCTCAGTCTGTGGACAGCAATGTTGCCTGG
TATCAGCAGAAGCCCAGACAGAGCCCTAAAGCCCTGATCTTTT
CTGCCAGCCTGAGATTTTCTGGCGTTCCTGCCAGATTTACCGGC
TCTGGCTCTGGCACCGATTTTACACTGACCATCAGCAATCTGCA
GTCTGAGGATCTGGCCGAGTACTTTTGCCAGCAGTACAACAAC
TACCCCCTGACCTTTGGAGCTGGCACAAAACTGGAGCTGAAGA
GTGCTGCTGCCTTTGTCCCGGTATTTCTCCCAGCCAAACCGACC
ACGACTCCCGCCCCGCGCCCTCCGACACCCGCTCCCACCATCG
CCTCTCAACCTCTTAGTCTTCGCCCCGAGGCATGCCGACCCGCC
GCCGGGGTGCTGTTCATACGAGGGGCTTGGACTTCGCTTGTG
ATATTTACATTTGGGCTCCGTTGGCGGGTACGTGCGGCGTCCTT
TTGTTGTCACTCGTTATTACTTTGTATTGTAATCACAGGAATCG
CTCAAAGCGGAGTAGGTTGTTGCATTCCGATTACATGAATATG
ACTCCTCGCCGGCCTGGGCCGACAAGAAAACATTACCAACCCT
ATGCCCCCACGAGACTTCGCTGCGTACAGGTCCCGAGTGAA
GTTTTCCCGAAGCGCAGACGCTCCGGCATATCAGCAAGGACAG
AATCAGCTGTATAACGAACTGAATTTGGGACGCCGCGAGGAGT
ATGACGTGCTTGATAAACGCCGGGGAGACCCGGAAATGG
GGGGTAAACCCCGAAGAAAGAATCCCCAAGAAGGACTCTACA
ATGAACTCCAGAAGGATAAGATGGCGGAGGCCTACTCAGAAA
TAGGTATGAAGGGCGAACGACGACGGGGAAAAGGTCACGATG
GCCTCTACCAAGGGGTTGAGTACGGCAACCAAAGATACGTACGA
TGCACTGCATATGCAGGCCCTGCCTCCCAGATAATAATAAAAT |

TABLE 35-continued

Donor Template Nucleotide Sequences-Left Homology Arm to Right Homology Arm

| SEQ ID NO: | Description | Sequence |
|---|---|---|
| | | CGCTATCCATCGAAGATGGATGTGTGTTGGTTTTTTGTGTGTGG<br>AGCAACAAATCTGACTTTGCATGTGCAAACGCCTTCAACAACA<br>GCATTATTCCAGAAGACACCTTCTTCCCCAGCCCAGGTAAGGG<br>CAGCTTTGGTGCCTTCGCAGGCTGTTTCCTTGCTTCAGGAATGG<br>CCAGGTTCTGCCCAGAGCTCTGGTCAATGATGTCTAAAACTCCT<br>CTGATTGGTGGTCTCGGCCTTATCCATTGCCACCAAAACCCTCT<br>TTTTACTAAGAAACAGTGAGCCTTGTTCTGGCAGTCCAGAGAA<br>TGACACGGGAAAAAAGCAGATGAAGAGAAGGTGGCAGGAGAG<br>GGCACGTGGCCCAGCCTCAGTCTCTCCAACTGAGTTCCTGCCTG<br>CCTGCCTTTGCTCAGACTGTTTGCCCCTTACTGCTCTTCTAGGCC<br>TCATTCTAAGCCCCTTCTCCAAGTTGCCTCTCCTTATTTCTCCCT<br>GTCTGCCAAAAAATCTTTCCCAGCTCACTAAGTCAGTCTCACGC<br>AGTCACTCATTAACCCACCAATCACTGATTGTGCCGGCACATG<br>AATGCACCAGGTGTTGAAGTGGAGGAATTAAAAAGTCAGATG<br>AGGGGTGTGCCCAGAGGAAGCACCATTCTAGTTGGGGGAGCCC<br>ATCTGTCAGCTGGGAAAAGTCCAATAACTTCAGATTGGAATG<br>TGTTTTAACTCAGGGTTGAGAAAACAGCTACCTTCAGGACAAA<br>AGTCAGGGAAGGGCTCTCTGAAGAAATGCTACTTGAAGATACC<br>AGCCCTACCAAGGGCAGGGAGAGGACCCTATAGAGGCCTGGG<br>ACAGGAGCTCAATGAGAAA |
| 1399 | LHA to RHA of CTX-154 | GAAGATCCTATTAAATAAAAGAATAAGCAGTATTATTAAGTAG<br>CCCTGCATTTCAGGTTTCCTTGAGTGGCAGGCCAGGCCTGGCCG<br>TGAACGTTCACTGAAATCATGGCCTCTTGGCCAAGATTGATAG<br>CTTGTGCCTGTCCCTGAGTCCCAGTCCATCACGAGCAGCTGGTT<br>TCTAAGATGCTATTTCCCGTATAAAGCATGAGACCGTGACTTGC<br>CAGCCCCACAGAGCCCCGCCCTTGTCCATCACTGGCATCTGGA<br>CTCCAGCCTGGGTTGGGGCAAAGAGGGAAATGAGATCATGTCC<br>TAACCCTGATCCTCTTGTCCCACAGATATCCAGAACCCTGACCC<br>TGCCGTGTACCAGCTGAGAGACTCTAAATCCAGTGACAAGTCT<br>GTCTGCCTATTCACCGATTTTGATTCTCAAACAAATGTGTCACA<br>AAGTAAGGATTCTGATGTGTATATCACAGACAAAACTGTGCTA<br>GACATGAGGTCTATGGACTTCAGGCTCCGGTGCCCGTCAGTGG<br>GCAGAGCGCACATCGCCCACAGTCCCCGAGAAGTTGGGGGGA<br>GGGGTCGGCAATTGAACCGGTGCCTAGAGAAGGTGGCGCGGG<br>GTAAACTGGGAAAGTGATGTCGTGTACTGGCTCCGCCTTTTTCC<br>CGAGGGTGGGGGAGAACCGTATATAAGTGCAGTAGTCGCCGTG<br>AACGTTCTTTTTCGCAACGGGTTTGCCGCCAGAACACAGGTAA<br>GTGCCGTGTGTGGTTCCCGCGGGCCTGGCCTCTTTACGGGTTAT<br>GGCCCTTGCGTGCCTTGAATTACTTCCACTGGCTGCAGTACGTG<br>ATTCTTGATCCCGAGCTTCGGGTTGGAAGTGGGTGGGAGAGTT<br>CGAGGCCTTGCGCTTAAGGAGCCCCTTCGCCTCGTGCTTGAGTT<br>GAGGCCTGGCCTGGGCGCTGGGGCGCCGCGTGCGAATCTGGT<br>GGCACCTTCGCGCCTGTCTCGCTGCTTTCGATAAGTCTCTAGCC<br>ATTTAAAATTTTTGATGACCTGCTGCGACGCTTTTTTTCTGGCA<br>AGATAGTCTTGTAAATGCGGGCCAAGATCTGCACACTGGTATT<br>TCGGTTTTTGGGGCCGCGGGCGGCGACGGGGCCCGTGCGTCCC<br>AGCGCACATGTTCGGCGAGGCGGGCCTGCGAGCGCGGCCACC<br>GAGAATCGGACGGGGGTAGTCTCAAGCTGGCCGGCCTGCTCTG<br>GTGCCTGGCCTCGCGCCGCCGTGTATCGCCCCGCCCTGGGCGG<br>CAAGGCTGGCCCGGTCGGCACCAGTTGCGTGAGCGGAAAGATG<br>GCCGCTTCCCGGCCCTGCTGCAGGGAGCTCAAAATGGAGGACG<br>CGGCGCTCGGGAGAGCGGGCGGGTGAGTCACCCACACAAAGG<br>AAAAGGGCCTTTCCGTCCTCAGCCGTCGCTTCATGTGACTCCAC<br>GGAGTACCGGGCGCCGTCCAGGCACCTCGATTAGTTCTCGAGC<br>TTTTGGAGTACGTCGTCTTTAGGTTGGGGGGAGGGGTTTTATGC<br>GATGGAGTTTCCCCACACTGAGTGGGTGGAGACTGAAGTTAGG<br>CCAGCTTGGCACTTGATGTAATTCTCCTTGGAATTTGCCCTTTTT<br>GAGTTTGGATCTTGGTTCATTCTCAAGCCTCAGACAGTGGTTCA<br>AGTTTTTTTCTTCCATTTCAGGTGTCGTGACCACCATGGCTCTT<br>CCTGTAACCGCACTTCTGCTTCCTCTTGCTCTGCTGCTTCATGCT<br>GCTAGACCTGACATCGTGATGACCCAAAGCCAGAGGTTCATGA<br>CCACATCTGTGGGCGATAGAGTGAGCGTGACCTGTAAAGCCTC<br>TCAGTCTGTGGACAGCAATGTTGCCTGGTATCAGCAGAAGCCT<br>AGACAGAGCCCTAAAGCCCTGATCTTTAGCGCCAGCCTGAGAT<br>TTAGCGGAGTTCCTGCCAGATTTACCGGAAGCGGATCTGGAAC<br>CGATTTTACACTGACCATCAGCAACCTGCAGAGCGAGGATCTG<br>GCCGAGTACTTTTGCCAGCAGTACAACAATTACCCTCTGACCTT<br>TGGAGCCGGCACAAAGCTGGAGCTGAAAGGAGGAGGAGGATC<br>TGGTGGTGGTGGTTCAGGAGGTGGAGGTTCGGGACAAGTTCAA<br>TTACAGCAATCTGGAGGAGGACTGGTTCAGCCTGGAGGAAGCC<br>TGAAGCTGTCTTGTGCCGCTTCTGGAATCGATTTTAGCAGATAC<br>TGGATGAGCTGGGTGAGAAGAGCCCCTGGCAAAGGACTGGAG<br>TGGATTGGCGAGATTAATCCTGATAGCAGCACCATCAACTATG<br>CCCCTAGCCTGAAGGACAAGTTCATCATCAGCCGGGACAATGC |

TABLE 35-continued

Donor Template Nucleotide Sequences-Left Homology Arm to Right Homology Arm

| SEQ ID NO: | Description | Sequence |
|---|---|---|
| | | CAAGAACACCCTGTACCTGCAAATGAGCAAGGTGAGGAGCGA<br>GGATACAGCTCTGTACTACTGTGCCAGCCTGTACTACGATTACG<br>GAGATGCTATGGACTATTGGGGCCAGGGAACAAGCGTTACAGT<br>GAGCAGCAGTGCTGCTGCCTTTGTCCCGGTATTTCTCCCAGCCA<br>AACCGACCACGACTCCCGCCCCGCGCCCTCCGACACCCGCTCC<br>CACCATCGCCTCTCAACCTCTTAGTCTTCGCCCCGAGGCATGCC<br>GACCCGCCGCCGGGGGTGCTGTTCATACGAGGGGCTTGGACTT<br>CGCTTGTGATATTTACATTTGGGCTCCGTTGGCGGGTACGTGCG<br>GCGTCCTTTTGTTGTCACTCGTTATTACTTTGTATTGTAATCACA<br>GGAATCGCTCAAAGCGGAGTAGGTTGTTGCATTCCGATTACAT<br>GAATATGACTCCTCGCCGGCCTGGGCCGACAAGAAAACATTAC<br>CAACCCTATGCCCCCCCACGAGACTTCGCTGCGTACAGGTCCC<br>GAGTGAAGTTTTCCCGAAGCGCAGACGCTCCGGCATATCAGCA<br>AGGACAGAATCAGCTGTATAACGAACTGAATTTGGGACGCCGC<br>GAGGAGTATGACGTGCTTGATAAACGCCGGGGGAGAGACCCG<br>GAAATGGGGGTAAACCCCGAAGAAAGAATCCCCAAGAAGGA<br>CTCTACAATGAACTCCAGAAGGATAAGATGGCGGAGGCCTACT<br>CAGAAATAGGTATGAAGGGCGAACGACGACGGGGAAAAGGTC<br>ACGATGGCCTCTACCAAGGGTTGAGTACGGCAACCAAAGATAC<br>GTACGATGCACTGCATATGCAGGCCCTGCCTCCCAGAGGAAGC<br>GGAGCTACTAACTTCAGCCTGCTGAAGCAGGCTGGAGACGTGG<br>AGGAGAACCCTGGACCTATGGTGAGCAAGGGCGAGGAGCTGT<br>TCACCGGGGTGGTGCCCATCCTGGTCGAGCTGGACGGCGACGT<br>AAACGGCCACAAGTTCAGCGTGTCCGGCGAGGGCGAGGGCGA<br>TGCCACCTACGGCAAGCTGACCCTGAAGTTCATCTGCACCACC<br>GGCAAGCTGCCCGTGCCCTGGCCCACCCTCGTGACCACCCTGA<br>CCTACGGCGTGCAGTGCTTCAGCCGCTACCCCGACCACATGAA<br>GCAGCACGACTTCTTCAAGTCCGCCATGCCCGAAGGCTACGTC<br>CAGGAGCGCACCATCTTCTTCAAGGACGACGGCAACTACAAGA<br>CCCGCGCCGAGGTGAAGTTCGAGGGCGACACCCTGGTGAACCG<br>CATCGAGCTGAAGGGCATCGACTTCAAGGAGGACGGCAACATC<br>CTGGGGCACAAGCTGGAGTACAACTACAACAGCCACAACGTCT<br>ATATCATGGCCGACAAGCAGAAGAACGGCATCAAGGTGAACTT<br>CAAGATCCGCCACAACATCGAGGACGGCAGCGTGCAGCTCGCC<br>GACCACTACCAGCAGAACACCCCCATCGGCGACGGCCCCGTGC<br>TGCTGCCCGACAACCACTACCTGAGCACCCAGTCCGCCCTGAG<br>CAAAGACCCCAACGAGAAGCGCGATCACATGGTCCTGCTGGAG<br>TTCGTGACCGCCGCCGGGATCACTCTCGGCATGGACGAGCTGT<br>ACAAGTAATAATAAAATAAAATCGCTATCCATCGAAGATGGAT<br>GTGTGTTGGTTTTTTGTGTGTGGAGCAACAAATCTGACTTTGCA<br>TGTGCAAACGCCTTCAACAACAGCATTATTCCAGAAGACACCT<br>TCTTCCCCAGCCCAGGTAAGGGCAGCTTTGGTGCCTTCGCAGG<br>CTGTTTCCTTGCTTCAGGAATGGCCAGGTTCTGCCCAGAGCTCT<br>GGTCAATGATGTCTAAAACTCCTCTGATTGGTGGTCTCGGCCTT<br>ATCCATTGCCACCAAAACCCTCTTTTTACTAAGAAACAGTGAG<br>CCTTGTTCTGGCAGTCCAGAGAATGACACGGGAAAAAAGCAGA<br>TGAAGAGAAGGTGGCAGGAGAGGGCACGTGGCCCAGCCTCAG<br>TCTCTCCAACTGAGTTCCTGCCTGCCTGCCTTTGCTCAGACTGT<br>TTGCCCCTTACTGCTCTTCTAGGCCTCATTCTAAGCCCCTTCTCC<br>AAGTTGCCTCTCCTTATTTCTCCCTGTCTGCCAAAAAATCTTTCC<br>CAGCTCACTAAGTCAGTCTCACGCAGTCACTCATTAACCC |
| 1400 | LHA to RHA of CTX-155 | GAGATGTAAGGAGCTGCTGTGACTTGCTCAAGGCCTTATATCG<br>AGTAAACGGTAGTGCTGGGGCTTAGACGCAGGTGTTCTGATTT<br>ATAGTTCAAAACCTCTATCAATGAGAGAGCAATCTCCTGGTAA<br>TGTGATAGATTTCCCAACTTAATGCCAACATACCATAAACCTCC<br>CATTCTGCTAATGCCCAGCCTAAGTTGGGGAGACCACTCCAGA<br>TTCCAAGATGTACAGTTTGCTTTGCTGGGCCTTTTTCCCATGCC<br>TGCCTTTACTCTGCCAGAGTTATATTGCTGGGGTTTTGAAGAAG<br>ATCCTATTAAATAAAAGAATAAGCAGTATTATTAAGTAGCCCT<br>GCATTTCAGGTTTCCTTGAGTGGCAGGCCAGGCCTGGCCGTGA<br>ACGTTCACTGAAATCATGGCCTCTTGGCCAAGATTGATAGCTTG<br>TGCCTGTCCCTGAGTCCCAGTCCATCACGAGCAGCTGGTTTCTA<br>AGATGCTATTTCCCGTATAAAGCATGAGACCGTGACTTGCCAG<br>CCCCACAGAGCCCCGCCCTTGTCCATCACTGGCATCTGGACTCC<br>AGCCTGGGTTGGGGCAAAGAGGGAAATGAGATCATGTCCTAAC<br>CCTGATCCTCTTGTCCCACAGATATCCAGAACCCTGACCCTGCC<br>GTGTACCAGCTGAGAGACTCTAAATCCAGTGACAAGTCTGTCT<br>GCCTATTCACCGATTTTGATTCTCAAACAAATGTGTCACAAAGT<br>AAGGATTCTGATGTGTATATCACAGACAAAACTGTGCTAGACA<br>TGAGGTCTATGGACTTCAGGCTCCGGTGCCCGTCAGTGGGCAG<br>AGCGCACATCGCCCACAGTCCCCGAGAAGTTGGGGGAGGGG<br>TCGGCAATTGAACCGGTGCCTAGAGAAGGTGGCGCGGGGTAA<br>ACTGGGAAAGTGATGTCGTGTACTGGCTCCGCCTTTTTCCCGAG<br>GGTGGGGGAGAACCGTATATAAGTGCAGTAGTCGCCGTGAACG |

TABLE 35-continued

Donor Template Nucleotide Sequences-Left Homology Arm to Right Homology Arm

| SEQ ID NO: | Description | Sequence |
|---|---|---|
| | | TTCTTTTTCGCAACGGGTTTGCCGCCAGAACACAGGTAAGTGCC
GTGTGTGGTTCCCGCGGGCCTGGCCTCTTTACGGGTTATGGCCC
TTGCGTGCCTTGAATTACTTCCACTGGCTGCAGTACGTGATTCT
TGATCCCGAGCTTCGGGTTGGAAGTGGGTGGGAGAGTTCGAGG
CCTTGCGCTTAAGGAGCCCCTTCGCCTCGTGCTTGAGTTGAGGC
CTGGCCTGGGCGCTGGGGCCGCCGCGTGCGAATCTGGTGGCAC
CTTCGCGCCTGTCTCGCTGCTTTCGATAAGTCTCTAGCCATTTA
AAATTTTTGATGACCTGCTGCGACGCTTTTTTTCTGGCAAGATA
GTCTTGTAAATGCGGGCCAAGATCTGCACACTGGTATTTCGGTT
TTTGGGGCCGCGGGCGGCGACGGGGCCCGTGCGTCCCAGCGCA
CATGTTCGGCGAGGCGGGGCCTGCGAGCGCGGCCACCGAGAAT
CGGACGGGGGTAGTCTCAAGCTGGCCGGCCTGCTCTGGTGCCT
GGCCTCGCGCCGCCGTGTATCGCCCCGCCCTGGGCGGCAAGGC
TGGCCCGGTCGGCACCAGTTGCGTGAGCGGAAAGATGGCCGCT
TCCCGGCCCTGCTGCAGGGAGCTCAAAATGGAGGACGCGGCGC
TCGGGAGAGCGGGCGGGTGAGTCACCCACACAAAGGAAAAGG
GCCTTTCCGTCCTCAGCCGTCGCTTCATGTGACTCCACGGAGTA
CCGGGCGCCGTCCAGGCACCTCGATTAGTTCTCGAGCTTTTGGA
GTACGTCGTCTTTAGGTTGGGGGGAGGGGTTTTATGCGATGGA
GTTTCCCCACACTGAGTGGGTGGAGACTGAAGTTAGGCCAGCT
TGGCACTTGATGTAATTCTCCTTGGAATTTGCCCTTTTTGAGTTT
GGATCTTGGTTCATTCTCAAGCCTCAGACAGTGGTTCAAAGTTT
TTTTCTTCCATTTCAGGTGTCGTGACCACCATGGCTCTTCCTGTA
ACCGCACTTCTGCTTCCTCTTGCTCTGCTGCTTCATGCTGCTAG
ACCTGACATCGTGATGACCCAAAGCCAGAGGTTCATGACCACA
TCTGTGGGCGATAGAGTGAGCGTGACCTGTAAAGCCTCTCAGT
CTGTGGACAGCAATGTTGCCTGGTATCAGCAGAAGCCTAGACA
GAGCCCTAAAGCCCTGATCTTTAGCGCCAGCCTGAGATTTAGC
GGAGTTCCTGCCAGATTTACCGGAAGCGGATCTGGAACCGATT
TTACACTGACCATCAGCAACCTGCAGAGCGAGGATCTGGCCGA
GTACTTTTGCCAGCAGTACAACAATTACCCTCTGACCTTTGGAG
CCGGCACAAAGCTGGAGCTGAAAGGAGGAGGAGGATCTGGTG
GTGGTGGTTCAGGAGGTGGAGGTTCGGGACAAGTTCAATTACA
GCAATCTGGAGGAGGACTGGTTCAGCCTGGAGGAAGCCTGAA
GCTGTCTTGTGCCGCTTCTGGAATCGATTTTAGCAGATACTGGA
TGAGCTGGGTGAGAAGAGCCCCTGGCAAAGGACTGGAGTGGA
TTGGCGAGATTAATCCTGATAGCAGCACCATCAACTATGCCCC
TAGCCTGAAGGACAAGTTCATCATCAGCCGGGACAATGCCAAG
AACACCCTGTACCTGCAAATGAGCAAGGTGAGGAGCGAGGAT
ACAGCTCTGTACTACTGTGCCAGCCTGTACTACGATTACGGAG
ATGCTATGGACTATTGGGGCCAGGGAACAAGCGTTACAGTGAG
CAGCAGTGCTGCTGCCTTTGTCCCGGTATTTCTCCCAGCCAAAC
CGACCACGACTCCCGCCCCGCGCCCTCCGACACCCGCTCCCAC
CATCGCCTCTCAACCTCTTAGTCTTCGCCCCGAGGCATGCCGAC
CCGCCGCCGGGGGTGCTGTTCATACGAGGGGCTTGGACTTCGC
TTGTGATATTTACATTTGGGCTCCGTTGGCGGGTACGTGCGGCG
TCCTTTTGTTGTCACTCGTTATTACTTTGTATTGTAATCACAGGA
ATCGCTCAAAGCGGAGTAGGTTGTTGCATTCCGATTACATGAA
TATGACTCCTCGCCGGCCTGGGCCGACAAGAAAACATTACCAA
CCCTATGCCCCCCCACGAGACTTCGCTGCGTACAGGTCCCGAG
TGAAGTTTTCCCGAAGCGCAGACGCTCCGGCATATCAGCAAGG
ACAGAATCAGCTGTATAACGAACTGAATTTGGGACGCCGCGAG
GAGTATGACGTGCTTGATAAACGCCGGGGGAGAGACCCGGAA
ATGGGGGGTAAACCCCGAAGAAAGAATCCCCAAGAAGGACTC
TACAATGAACTCCAGAAGGATAAGATGGCGGAGGCCTACTCAG
AAATAGGTATGAAGGGCGAACGACGACGGGGAAAAGGTCACG
ATGGCCTCTACCAAGGGTTGAGTACGGCAACCAAAGATACGTA
CGATGCACTGCATATGCAGGCCCTGCCTCCCAGATAATAATAA
AATCGCTATCCATCGAAGATGGATGTGTGTTGGTTTTTTGTGTG
TGGAGCAACAAATCTGACTTTGCATGTGCAAACGCCTTCAACA
ACAGCATTATTCCAGAAGACACCTTCTTCCCCAGCCCAGGTAA
GGGCAGCTTTGGTGCCTTCGCAGGCTGTTTCCTTGCTTCAGGAA
TGGCCAGGTTCTGCCCAGAGCTCTGGTCAATGATGTCTAAAAC
TCCTCTGATTGGTGGTCTCGGCCTTATCATTGCCACCAAAACC
CTCTTTTTACTAAGAAACAGTGAGCCTTGTTCTGGCAGTCCAGA
GAATGACACGGGAAAAAAGCAGATGAAGAGAAGGTGGCAGGA
GAGGGCACGTGGCCCAGCCTCAGTCTCTCCAACTGAGTTCCTG
CCTGCCTGCCTTTGCTCAGACTGTTTGCCCCTTACTGCTCTTCTA
GGCCTCATTCTAAGCCCCTTCTCCAAGTTGCCTCTCCTTATTTCT
CCCTGTCTGCCAAAAATCTTTCCCAGCTCACTAAGTCAGTCTC
ACGCAGTCACTCATTAACCCACCAATCACTGATTGTGCCGGCA
CATGAATGCACCAGGTGTTGAAGTGGAGGAATTAAAAGTCAG
ATGAGGGGTGTGCCCAGAGGAAGCACCATTCTAGTTGGGGGAG
CCCATCTGTCAGCTGGGAAAAGTCCAAATAACTTCAGATTGGA
ATGTGTTTTAACTCAGGGTTGAGAAAACAGCTACCTTCAGGAC |

TABLE 35-continued

Donor Template Nucleotide Sequences-Left Homology Arm to Right Homology Arm

| SEQ ID NO: | Description | Sequence |
|---|---|---|
|  |  | AAAAGTCAGGGAAGGGCTCTCTGAAGAAATGCTACTTGAAGAT<br>ACCAGCCCTACCAAGGGCAGGGAGAGGACCCTATAGAGGCCT<br>GGGACAGGAGCTCAATGAGAAA |
| 1401 | LHA to RHA of CTX-160 | GAGATGTAAGGAGCTGCTGTGACTTGCTCAAGGCCTTATATCG<br>AGTAAACGGTAGTGCTGGGGCTTAGACGCAGGTGTTCTGATTT<br>ATAGTTCAAAACCTCTATCAATGAGAGAGCAATCTCCTGGTAA<br>TGTGATAGATTTCCCAACTTAATGCCAACATACCATAAACCTCC<br>CATTCTGCTAATGCCCAGCCTAAGTTGGGGAGACCACTCCAGA<br>TTCCAAGATGTACAGTTTGCTTTGCTGGGCCTTTTTCCCATGCC<br>TGCCTTTACTCTGCCAGAGTTATATTGCTGGGGTTTTGAAGAAG<br>ATCCTATTAAATAAAAGAATAAGCAGTATTATTAAGTAGCCCT<br>GCATTTCAGGTTTCCTTGAGTGGCAGGCCAGGCCTGGCCGTGA<br>ACGTTCACTGAAATCATGGCCTCTTGGCCAAGATTGATAGCTTG<br>TGCCTGTCCCTGAGTCCCAGTCCATCACGAGCAGCTGGTTTCTA<br>AGATGCTATTTCCCGTATAAAGCATGAGACCGTGACTTGCCAG<br>CCCCACAGAGCCCCGCCCTTGTCCATCACTGGCATCTGGACTCC<br>AGCCTGGGTTGGGGCAAAGAGGGAAATGAGATCATGTCCTAAC<br>CCTGATCCTCTTGTCCCACAGATATCCAGAACCCTGACCCTGCC<br>GTGTACCAGCTGAGAGACTCTAAATCCAGTGACAAGTCTGTCT<br>GCCTATTCACCGATTTTGATTCTCAAACAAATGTGTCACAAAGT<br>AAGGATTCTGATGTGTATATCACAGACAAAACTGTGCTAGACA<br>TGAGGTCTATGGACTTCAGGCTCCGGTGCCCGTCAGTGGGCAG<br>AGCGCACATCGCCCACAGTCCCCGAGAAGTTGGGGGGAGGGG<br>TCGGCAATTGAACCGGTGCCTAGAGAAGGTGGCGCGGGGTAA<br>ACTGGGAAAGTGATGTCGTGTACTGGCTCCGCCTTTTTCCCGAG<br>GGTGGGGGAGAACCGTATATAAGTGCAGTAGTCGCCGTGAACG<br>TTCTTTTTCGCAACGGGTTTGCCGCCAGAACACAGGTAAGTGCC<br>GTGTGTGGTTCCCGCGGGCCTGGCCTCTTTACGGGTTATGGCCC<br>TTGCGTGCCTTGAATTACTTCCACTGGCTGCAGTACGTGATTCT<br>TGATCCCGAGCTTCGGGTTGGAAGTGGGTGGGAGAGTTCGAGG<br>CCTTGCGCTTAAGGAGCCCCTTCGCCTCGTGCTTGAGTTGAGGC<br>CTGGCCTGGGCGCTGGGGCCGCCGCGTGCGAATCTGGTGGCAC<br>CTTCGCGCCTGTCTCGCTGCTTTCGATAAGTCTCTAGCCATTTA<br>AAATTTTTGATGACCTGCTGCGACGCTTTTTTTCTGGCAAGATA<br>GTCTTGTAAATGCGGGCCAAGATCTGCACACTGGTATTTCGGTT<br>TTTGGGGCCGCGGGCGGCGACGGGGCCCGTGCGTCCCAGCGCA<br>CATGTTCGGCGAGGCGGGGCCTGCGAGCGCGGCCACCGAGAAT<br>CGGACGGGGGTAGTCTCAAGCTGGCCGGCCTGCTCTGGTGCCT<br>GGCCTCGCGCCGCCGTGTATCGCCCCGCCCTGGGCGGCAAGGC<br>TGGCCCGGTCGGCACCAGTTGCGTGAGCGGAAAGATGGCCGCT<br>TCCCGCCCTGCTGCAGGGAGCTCAAAATGGAGGACGCGGCGC<br>TCGGGAGAGCGGGCGGGTGAGTCACCCACACAAAGGAAAAGG<br>GCCTTTCCGTCCTCAGCCGTCGCTTCATGTGACTCCACGGAGTA<br>CCGGGCGCCGTCCAGGCACCTCGATTAGTTCTCGAGCTTTTGGA<br>GTACGTCGTCTTTAGGTTGGGGGGAGGGGTTTTATGCGATGGA<br>GTTTCCCCACACTGAGTGGGTGGAGACTGAAGTTAGGCCAGCT<br>TGGCACTTGATGTAATTCTCCTTGGAATTTGCCCTTTTTGAGTTT<br>GGATCTTGGTTCATTCTCAAGCCTCAGACAGTGGTTCAAAGTTT<br>TTTTCTTCCATTTCAGGTGTCGTGACCACCATGGCGCTTCCGGT<br>GACAGCACTGCTCCTCCCCTTGGCGCTGTTGCTCCACGCAGCAA<br>GGCCGGAGGTCCAGCTGGTGGAGAGCGGCGGAGGACTGGTCC<br>AGCCTGGCGGCTCCCTGAAACTGAGCTGCGCCGCCAGCGGCAT<br>CGACTTCAGCAGGTACTGGATGAGCTGGGTGAGACAGGCCCCT<br>GGCAAGGGCCTGGAATGGATCGGCGAGATCAACCCCGACTCCA<br>GCACCATCAACTACGCCGACAGCGTCAAGGGCAGGTTCACCAT<br>TAGCAGGGACAATGCCAAGAACACCCTGTACCTGCAGATGAAC<br>CTGAGCAGGGCCGAAGACACCGCCCTGTACTACTGTGCCAGCC<br>TGTACTACGACTATGGCGACGCTATGGACTACTGGGGCCAGGG<br>CACCCTGGTGACAGTGAGCTCCGAGGAGGCGGCAGCGGCGG<br>AGGCGGCAGCGGCGGAGGCGGCAGCGACATCCAGATGACCCA<br>GAGCCCTAGCAGCCTGAGCGCCTCCGTGGGAGATAGGGTGACA<br>ATCACCTGTAGGGCCAGCCAGAGCGTGGACTCCAACGTGGCCT<br>GGTATCAACAGAAGCCCGAGAAGGCCCCAAGAGCCTGATCTT<br>TTCCGCCTCCCTGAGGTTCAGCGGAGTCCCCAGCAGGTTCTCCG<br>GATCCGGCTCCGGAACCGACTTTACCCTGACCATCTCCAGCCTG<br>CAGCCCGAGGACTTCGCCACCTACTACTGCCAGCAGTACAACA<br>GCTACCCCCTGACCTTCGGCGCCGGCACAAAGCTGGAGATCAA<br>GAGTGCTGCTGCCTTTGTCCCGGTATTTCTCCCAGCCAAACCGA<br>CCACGACTCCCGCCCCGCGCCTCCGACACCCGCTCCCACCATC<br>GCCTCTCAACCTCTTAGTCTTCGCCCCGAGGCATGCCGACCCGC<br>CGCCGGGGGTGCTGTTCATACGAGGGGCTTGGACTTCGCTTGT<br>GATATTTACATTTGGGCTCCGTTGGCGGGTACGTGCGGCGTCCT<br>TTTGTTGTCACTCGTTATTACTTTGTATTGTAATCACAGGAATC<br>GCTCAAAGCGGAGTAGGTTGTTGCATTCCGATTACATGAATAT |

TABLE 35-continued

Donor Template Nucleotide Sequences-Left Homology Arm to Right Homology Arm

| SEQ ID NO: | Description | Sequence |
|---|---|---|
| | | GACTCCTCGCCGGCCTGGGCCGACAAGAAAACATTACCAACCC<br>TATGCCCCCCACGAGACTTCGCTGCGTACAGGTCCCGAGTGA<br>AGTTTTCCCGAAGCGCAGACGCTCCGGCATATCAGCAAGGACA<br>GAATCAGCTGTATAACGAACTGAATTTGGGACGCCGCGAGGAG<br>TATGACGTGCTTGATAAACGCCGGGGGAGAGACCCGGAAATG<br>GGGGGTAAACCCCGAAGAAAGAATCCCCAAGAAGGACTCTAC<br>AATGAACTCCAGAAGGATAAGATGGCGGAGGCCTACTCAGAA<br>ATAGGTATGAAGGGCGAACGACGACGGGGAAAAGGTCACGAT<br>GGCCTCTACCAAGGGTTGAGTACGGCAACCAAAGATACGTACG<br>ATGCACTGCATATGCAGGCCCTGCCTCCCAGATAATAATAAAA<br>TCGCTATCCATCGAAGATGGATGTGTGTTGGTTTTTTGTGTGTG<br>GAGCAACAAATCTGACTTTGCATGTGCAAACGCCTTCAACAAC<br>AGCATTATTCCAGAAGACACCTTCTTCCCCAGCCCAGGTAAGG<br>GCAGCTTTGGTGCCTTCGCAGGCTGTTTCCTTGCTTCAGGAATG<br>GCCAGGTTCTGCCCAGAGCTCTGGTCAATGATGTCTAAAACTC<br>CTCTGATTGGTGGTCTCGGCCTTATCCATTGCCACCAAAACCCT<br>CTTTTTACTAAGAAACAGTGAGCCTTGTTCTGGCAGTCCAGAG<br>AATGACACGGGAAAAAAGCAGATGAAGAGAAGGTGGCAGGAG<br>AGGGCACGTGGCCCAGCCTCAGTCTCTCCAACTGAGTTCCTGC<br>CTGCCTGCCTTTGCTCAGACTGTTTGCCCCTTACTGCTCTTCTAG<br>GCCTCATTCTAAGCCCCTTCTCCAAGTTGCCTCTCCTTATTTCTC<br>CCTGTCTGCCAAAAAATCTTTCCCAGCTCACTAAGTCAGTCTCA<br>CGCAGTCACTCATTAACCCACCAATCACTGATTGTGCCGGCAC<br>ATGAATGCACCAGGTGTTGAAGTGGAGGAATTAAAAAGTCAG<br>ATGAGGGGTGTGCCCAGAGGAAGCACCATTCTAGTTGGGGGAG<br>CCCATCTGTCAGCTGGGAAAAGTCCAAATAACTTCAGATTGGA<br>ATGTGTTTTAACTCAGGGTTGAGAAAACAGCTACCTTCAGGAC<br>AAAAGTCAGGGAAGGGCTCTCTGAAGAAATGCTACTTGAAGAT<br>ACCAGCCCTACCAAGGGCAGGGAGAGGACCCTATAGAGGCCT<br>GGGACAGGAGCTCAATGAGAAAGG |
| 1402 | LHA to RHA of<br>CTX-160b | GAGATGTAAGGAGCTGCTGTGACTTGCTCAAGGCCTTATATCG<br>AGTAAACGGTAGTGCTGGGGCTTAGACGCAGGTGTTCTGATTT<br>ATAGTTCAAAACCTCTATCAATGAGAGAGCAATCTCCTGGTAA<br>TGTGATAGATTTCCCAACTTAATGCCAACATACCATAAACCTCC<br>CATTCTGCTAATGCCCAGCCTAAGTTGGGGAGACCACTCCAGA<br>TTCCAAGATGTACAGTTTGCTTTGCTGGGCCTTTTTCCCATGCC<br>TGCCTTTACTCTGCCAGAGTTATATTGCTGGGGTTTTGAAGAAG<br>ATCCTTATTAAATAAAAGAATAAGCAGTATTATTAAGTAGCCCT<br>GCATTTCAGGTTTCCTTGAGTGGCAGGCCAGGCCTGGCCGTGA<br>ACGTTCACTGAAATCATGGCCTCTTGGCCAAGATTGATAGCTTG<br>TGCCTGTCCCTGAGTCCCAGTCCATCACGAGCAGCTGGTTTCTA<br>AGATGCTATTTCCCGTATAAAGCATGAGACCGTGACTTGCCAG<br>CCCCACAGAGCCCCGCCCTTGTCCATCACTGGCATCTGGACTCC<br>AGCCTGGGTTGGGGCAAAGAGGGAAATGAGATCATGTCCTAAC<br>CCTGATCCTCTTGTCCCACAGATATCCAGAACCCTGACCCTGCC<br>GTGTACCAGCTGAGAGACTCTAAATCCAGTGACAAGTCTGTCT<br>GCCTATTCACCGATTTTGATTCTCAAACAAATGTGTCACAAAGT<br>AAGGATTCTGATGTGTATATCACAGACAAAACTGTGCTAGACA<br>TGAGGTCTATGGACTTCAGGCTCCGGTGCCCGTCAGTGGGCAG<br>AGCGCACATCGCCCACAGTCCCCGAGAAGTTGGGGGGAGGGG<br>TCGGCAATTGAACCGGTGCCTAGAGAAGGTGGCGCGGGGTAA<br>ACTGGGAAAGTGATGTCGTGTACTGGCTCCGCCTTTTTCCCGAG<br>GGTGGGGGAGAACCGTATATAAGTGCAGTAGTCGCCGTGAACG<br>TTCTTTTTCGCAACGGGTTTGCCGCCAGAACACAGGTAAGTGCC<br>GTGTGTGGTTCCCGCGGGCCTGGCCTCTTTACGGGTTATGGCCC<br>TTGCGTGCCTTGAATTACTTCCACTGGCTGCAGTACGTGATTCT<br>TGATCCCGAGCTTCGGGTTGGAAGTGGGTGGGAGAGTTCGAGG<br>CCTTGCGCTTAAGGAGCCCCTTCGCCTCGTGCTTGAGTTGAGGC<br>CTGGCCTGGGCGCTGGGGCCGCCGCGTGCGAATCTGGTGGCAC<br>CTTCGCGCCTGTCTCGCTGCTTTCGATAAGTCTCTAGCCATTTA<br>AAATTTTTGATGACCTGCTGCGACGCTTTTTTTCTGGCAAGATA<br>GTCTTGTAAATGCGGGCCAAGATCTGCACACTGGTATTTCGGTT<br>TTTGGGGCCGCGGGCGGCGACGGGGCCCGTGCGTCCCAGCGCA<br>CATGTTCGGCGAGGCGGGGCCTGCGAGCGCGGCCACCGAGAAT<br>CGGACGGGGGTAGTCTCAAGCTGGCCGGCCTGCTCTGGTGCCT<br>GGCCTCGCGCCGCCGTGTATCGCCCCGCCCTGGGCGGCAAGGC<br>TGGCCCGGTCGGCACCAGTTGCGTGAGCGGAAAGATGGCCGCT<br>TCCCGGCCCTGCTGCAGGGAGCTCAAAATGGAGGACGCGGCGC<br>TCGGGAGAGCGGGCGGGTGAGTCACCCACACAAAGGAAAAGG<br>GCCTTTCCGTCCTCAGCCGTCGCTTCATGTGACTCCACGGAGTA<br>CCGGGCGCCGTCCAGGCACCTCGATTAGTTCTCGAGCTTTTGGA<br>GTACGTCGTCTTTAGGTTGGGGGGAGGGGTTTTATGCGATGGA<br>GTTTCCCCACACTGAGTGGGTGGAGACTGAAGTTAGGCCAGCT<br>TGGCACTTGATGTAATTCTCCTTGGAATTTGCCCTTTTTGAGTTT |

TABLE 35-continued

Donor Template Nucleotide Sequences-Left Homology Arm to Right Homology Arm

| SEQ ID NO: | Description | Sequence |
|---|---|---|
| | | GGATCTTGGTTCATTCTCAAGCCTCAGACAGTGGTTCAAAGTTT<br>TTTTCTTCCATTTCAGGTGTCGTGACCACCATGGCGCTTCCGGT<br>GACAGCACTGCTCCTCCCCTTGGCGCTGTTGCTCCACGCAGCAA<br>GGCCGGAGGTCCAGCTGGTGGAGAGCGGCGGAGGACTGGTCC<br>AGCTGGCGGCTCCCTGAAACTGAGCTGCGCCGCCAGCGGCAT<br>CGACTTCAGCAGGTACTGGATGAGCTGGGTGAGACAGGCCCCT<br>GGCAAGGGCCTGGAATGGATCGGCGAGATCAACCCCGACTCCA<br>GCACCATCAACTACGCCGACAGCGTCAAGGGCAGGTTCACCAT<br>TAGCAGGGACAATGCCAAGAACACCCTGTACCTGCAGATGAAC<br>CTGAGCAGGGCCGAAGACACCGCCCTGTACTACTGTGCCAGCC<br>TGTACTACGACTATGGCGACGCTATGGACTACTGGGGCCAGGG<br>CACCCTGGTGACAGTGAGCTCCGGAGGAGGCGGCAGCGGCGG<br>AGGCGGCAGCGGCGGAGGCGGCAGCGACATCCAGATGACCCA<br>GAGCCCTAGCAGCCTGAGCGCCTCCGTGGGAGATAGGGTGACA<br>ATCACCTGTAGGGCCAGCCAGAGCGTGGACTCCAACGTGGCCT<br>GGTATCAACAGAAGCCCGAGAAGGCCCCCAAGAGCCTGATCTT<br>TTCCGCCTCCCTGAGGTTCAGCGGAGTCCCCAGCAGGTTCTCCG<br>GATCCGGCTCCGGAACCGACTTTACCCTGACCATCTCCAGCCTG<br>CAGCCCGAGGACTTCGCCACCTACTACTGCCAGCAGTACAACA<br>GCTACCCCCTGACCTTCGGCGCCGGCACAAAGCTGGAGATCAA<br>GAGTGCTGCTGCCTTTGTCCCGGTATTTCTCCCAGCCAAACCGA<br>CCACGACTCCCGCCCCGCGCCCTCCGACACCCGCTCCCACCATC<br>GCCTCTCAACCTCTTAGTCTTCGCCCCGAGGCATGCCGACCCGC<br>CGCCGGGGGTGCTGTTCATACGAGGGGCTTGGACTTCGCTTGT<br>GATATTTACATTTGGGCTCCGTTGGCGGGTACGTGCGGCGTCCT<br>TTTGTTGTCACTCGTTATTACTTTGTATTGTAATCACAGGAATC<br>GCAAACGGGGCAGAAAGAAACTCCTGTATATATTCAAACAACC<br>ATTTATGAGACCAGTACAAACTACTCAAGAGGAAGATGGCTGT<br>AGCTGCCGATTTCCAGAAGAAGAAGAAGGAGGATGTGAACTG<br>CGAGTGAAGTTTTCCCGAAGCGCAGACGCTCCGGCATATCAGC<br>AAGGACAGAATCAGCTGTATAACGAACTGAATTTGGGACGCCG<br>CGAGGAGTATGACGTGCTTGATAAACGCCGGGGAGAGACCC<br>GGAAATGGGGGGTAAACCCCGAAGAAAGAATCCCCAAGAAGG<br>ACTCTACAATGAACTCCAGAAGGATAAGATGGCGGAGGCCTAC<br>TCAGAAATAGGTATGAAGGGCGAACGACGACGGGGAAAAGGT<br>CACGATGGCCTCTACCAAGGGTTGAGTACGGCAACCAAAGATA<br>CGTACGATGCACTGCATATGCAGGCCCTGCCTCCCAGATAATA<br>ATAAAATCGCTATCCATCGAAGATGGATGTGTGTTGGTTTTTTG<br>TGTGTGGAGCAACAAATCTGACTTTGCATGTGCAAACGCCTTC<br>AACAACAGCATTATTCCAGAAGACACCTTCTTCCCCAGCCCAG<br>GTAAGGGCAGCTTTGGTGCCTTCGCAGGCTGTTTCCTTGCTTCA<br>GGAATGGCCAGGTTCTGCCCAGAGCTCTGGTCAATGATGTCTA<br>AAACTCCTCTGATTGGTGGTCTCGGCCTTATCCATTGCCACCAA<br>AACCCTCTTTTTACTAAGAAACAGTGAGCCTTGTTCTGGCAGTC<br>CAGAGAATGACACGGGAAAAAAGCAGATGAAGAGAAGGTGGC<br>AGGAGAGGGCACGTGGCCCAGCCTCAGTCTCTCCAACTGAGTT<br>CCTGCCTGCCTGCCTTTGCTCAGACTGTTTGCCCCTTACTGCTCT<br>TCTAGGCCTCATTCTAAGCCCCTTCTCCAAGTTGCCTCTCCTTAT<br>TTCTCCCTGTCTGCCAAAAAATCTTTCCCAGCTCACTAAGTCAG<br>TCTCACGCAGTCACTCATTAACCCACCAATCACTGATTGTGCCG<br>GCACATGAATGCACCAGGTGTTGAAGTGGAGGAATTAAAAAGT<br>CAGATGAGGGGTGTGCCCAGAGGAAGCACCATTCTAGTTGGGG<br>GAGCCCATCTGTCAGCTGGGAAAAGTCCAAATAACTTCAGATT<br>GGAATGTGTTTTAACTCAGGGTTGAGAAAACAGCTACCTTCAG<br>GACAAAAGTCAGGGAAGGGCTCTCTGAAGAAATGCTACTTGAA<br>GATACCAGCCCTACCAAGGGCAGGGAGAGGACCCTATAGAGG<br>CCTGGGACAGGAGCTCAATGAGAAAGG |
| 1403 | LHA to RHA of CTX-161 | GAGATGTAAGGAGCTGCTGTGACTTGCTCAAGGCCTTATATCG<br>AGTAAACGGTAGTGCTGGGGCTTAGACGCAGGTGTTCTGATTT<br>ATAGTTCAAAACCTCTATCAATGAGAGAGCAATCTCCTGGTAA<br>TGTGATAGATTTCCCAACTTAATGCCAACATACCATAAACCTCC<br>CATTCTGCTAATGCCCAGCCTAAGTTGGGGAGACCACTCCAGA<br>TTCCAAGATGTACAGTTTGCTTTGCTGGGCCTTTTTCCCATGCC<br>TGCCTTTACTCTGCCAGAGTTATATTGCTGGGGTTTTGAAGAAG<br>ATCCTATTAAATAAAAGAATAAGCAGTATTATTAAGTAGCCCT<br>GCATTTCAGGTTTCCTTGAGTGGCAGGCCAGGCCTGGCCGTGA<br>ACGTTCACTGAAATCATGGCCTCTTGGCCAAGATTGATAGCTTG<br>TGCCTGTCCCTGAGTCCCAGTCCATCACGAGCAGCTGGTTTCTA<br>AGATGCTATTTCCCGTATAAAGCATGAGACGTGACTTGCCAG<br>CCCCACAGAGCCCCGCCCTTGTCCATCACTGGCATCTGGACTCC<br>AGCTGGGTTGGGCAAAGAGGGAAATGAGATCATGTCCTAAC<br>CCTGATCCTCTTGTCCCACAGATATCCAGAACCCTGACCCTGCC<br>GTGTACCAGCTGAGAGACTCTAAATCCAGTGACAAGTCTGTCT<br>GCCTATTCACCGATTTTGATTCTCAAACAAATGTGTCACAAAGT |

TABLE 35-continued

Donor Template Nucleotide Sequences-Left Homology Arm to Right Homology Arm

| SEQ ID NO: | Description | Sequence |
|---|---|---|
| | | AAGGATTCTGATGTGTATATCACAGACAAAACTGTGCTAGACA
TGAGGTCTATGGACTTCAGGCTCCGGTGCCCGTCAGTGGGCAG
AGCGCACATCGCCCACAGTCCCCGAGAAGTTGGGGGGAGGGG
TCGGCAATTGAACCGGTGCCTAGAGAAGGTGGCGCGGGGTAA
ACTGGGAAAGTGATGTCGTGTACTGGCTCCGCCTTTTTCCCGAG
GGTGGGGGAGAACCGTATATAAGTGCAGTAGTCGCCGTGAACG
TTCTTTTTCGCAACGGGTTTGCCGCCAGAACACAGGTAAGTGCC
GTGTGTGGTTCCCGCGGGCCTGGCCTCTTTACGGGTTATGGCCC
TTGCGTGCCTTGAATTACTTCCACTGGCTGCAGTACGTGATTCT
TGATCCCGAGCTTCGGGTTGGAAGTGGGTGGGAGAGTTCGAGG
CCTTGCGCTTAAGGAGCCCCTTCGCCTCGTGCTTGAGTTGAGGC
CTGGCCTGGGCGCTGGGGCCGCCGCGTGCGAATCTGGTGGCAC
CTTCGCGCCTGTCTCGCTGCTTTCGATAAGTCTCTAGCCATTTA
AAATTTTTGATGACCTGCTGCGACGCTTTTTTTCTGGCAAGATA
GTCTTGTAAATGCGGGCCAAGATCTGCACACTGGTATTTCGGTT
TTTGGGGCCGCGGGCGGCGACGGGGCCCGTGCGTCCCAGCGCA
CATGTTCGGCGAGGCGGGGCCTGCGAGCGCGGCCACCGAGAAT
CGGACGGGGGTAGTCTCAAGCTGGCCGGCCTGCTCTGGTGCCT
GGCCTCGCGCCGCCGTGTATCGCCCCGCCCTGGGCGGCAAGGC
TGGCCCGGTCGGCACCAGTTGCGTGAGCGGAAAGATGGCCGCT
TCCCGGCCCTGCTGCAGGGAGCTCAAAATGGAGGACGCGGCGC
TCGGGAGAGCGGGCGGGTGAGTCACCCACACAAAGGAAAAGG
GCCTTTCCGTCCTCAGCCGTCGCTTCATGTGACTCCACGGAGTA
CCGGGCGCCGTCCAGGCACCTCGATTAGTTCTCGAGCTTTTGGA
GTACGTCGTCTTTAGGTTGGGGGGAGGGGTTTTATGCGATGGA
GTTTCCCCACACTGAGTGGGTGGAGACTGAAGTTAGGCCAGCT
TGGCACTTGATGTAATTCTCCTTGGAATTTGCCCTTTTTGAGTTT
GGATCTTGGTTCATTCTCAAGCCTCAGACAGTGGTTCAAAGTTT
TTTTCTTCCATTTCAGGTGTCGTGACCACCATGGCGCTTCCGGT
GACAGCACTGCTCCTCCCCTTGGCGCTGTTGCTCCACGCAGCAA
GGCCGGAGGTGCAGCTGGTGGAGAGCGGAGGAGGACTGGTGC
AGCCCGGAGGCTCCCTGAAGCTGAGCTGCGCTGCCTCCGGCAT
CGACTTCAGCAGGTACTGGATGAGCTGGGTGAGGCAGGCTCCC
GGCAAAGGCCTGGAGTGGATCGGCGAGATCAACCCCGACAGC
AGCACCATCAACTACGCCGACAGCGTGAAGGGCAGGTTCACCA
TCAGCAGGGACAACGCCAAGAATACCCTGTACCTGCAGATGAA
CCTGAGCAGGGCCGAGGACACAGCCCTGTACTACTGTGCCAGC
CTGTACTACGACTATGGAGACGCTATGGACTACTGGGGCCAGG
GAACCCTGGTGACCGTGAGCAGCGGAGGCGGAGGCTCCGGCG
GCGGAGGCAGCGGAGGAGGCGGCAGCGATATCCAGATGACCC
AGTCCCCCAGCTCCCTGAGCGCTAGCCCTGGCGACAGGGTGAG
CGTGACATGCAAGGCCAGCCAGAGCGTGGACAGCAACGTGGC
CTGGTACCAGCAGAAACCCAGACAGGCCCCCAAGGCCCTGATC
TTCAGCGCCAGCCTGAGGTTTAGCGGCGTGCCCGCTAGGTTTA
CCGGATCCGGCAGCGGCACCGACTTCACCCTGACCATCTCCAA
CCTGCAGTCCGAGGACTTCGCCACCTACTACTGCCAGCAGTAC
AACAACTACCCCCTGACATTCGGCGCCGGAACCAAGCTGGAGA
TCAAGAGTGCTGCTGCCTTTGTCCCGGTATTTCTCCCAGCCAAA
CCGACCACGACTCCCGCCCCGCGCCCTCCGACACCCGCTCCCA
CCATCGCCTCTCAACCTCTTAGTCTTCGCCCCGAGGCATGCCGA
CCCGCCGCCGGGGGTGCTGTTCATACGAGGGGCTTGGACTTCG
CTTGTGATATTTACATTTGGGCTCCGTTGGCGGGTACGTGCGGC
GTCCTTTTGTTGTCACTCGTTATTACTTTGTATTGTAATCACAGG
AATCGCTCAAAGCGGAGTAGGTTGTTGCATTCCGATTACATGA
ATATGACTCCTCGCCGGCCTGGGCCGACAAGAAAACATTACCA
ACCCTATGCCCCCCACGAGACTTCGCTGCGTACAGGTCCCGA
GTGAAGTTTTCCCGAAGCGCAGACGCTCCGGCATATCAGCAAG
GACAGAATCAGCTGTATAACGAACTGAATTTGGGACGCCGCGA
GGAGTATGACGTGCTTGATAAACGCCGGGGGAGAGACCCGGA
AATGGGGGGTAAACCCCGAAGAAAGAATCCCCAAGAAGGACT
CTACAATGAACTCCAGAAGGATAAGATGGCGGAGGCCTACTCA
GAAATAGGTATGAAGGGCGAACGACGACGGGGAAAAGGTCAC
GATGGCCTCTACCAAGGGTTGAGTACGGCAACCAAAGATACGT
ACGATGCACTGCATATGCAGGCCCTGCCTCCCAGATAATAATA
AAATCGCTATCCATCGAAGATGGATGTGTTGGTTTTTTGTGT
GTGGAGCAACAAATCTGACTTTGCATGTGCAAACGCCTTCAAC
AACAGCATTATTCCAGAAGACACCTTCTTCCCCAGCCCAGGTA
AGGGCAGCTTTGGTGCCTTCGCAGGCTGTTTCCTTGCTTCAGGA
ATGGCCAGGTTCTGCCCAGAGCTCTGGTCAATGATGTCTAAAA
CTCCTCTGATTGGTGGTCTCGGCCTTATCCATTGCCACCAAAAC
CCTCTTTTTACTAAGAAACAGTGAGCCTTGTTCTGGCAGTCCAG
AGAATGACACGGGAAAAAAGCAGATGAAGAGAAGGTGGCAGG
AGAGGGCACGTGGCCCAGCCTCAGTCTCTCCAACTGAGTTCCT
GCCTGCCTGCCTTTGCTCAGACTGTTTGCCCCTTACTGCTCTTCT
AGGCCTCATTCTAAGCCCCTTCTCCAAGTTGCCTCTCCTTATTTC |

TABLE 35-continued

Donor Template Nucleotide Sequences-Left Homology Arm to Right Homology Arm

| SEQ ID NO: | Description | Sequence |
|---|---|---|
| | | TCCCTGTCTGCCAAAAAATCTTTCCCAGCTCACTAAGTCAGTCT<br>CACGCAGTCACTCATTAACCCACCAATCACTGATTGTGCCGGC<br>ACATGAATGCACCAGGTGTTGAAGTGGAGGAATTAAAAAGTCA<br>GATGAGGGGTGTGCCCAGAGGAAGCACCATTCTAGTTGGGGGA<br>GCCCATCTGTCAGCTGGGAAAAGTCCAAATAACTTCAGATTGG<br>AATGTGTTTTAACTCAGGGTTGAGAAAACAGCTACCTTCAGGA<br>CAAAAGTCAGGGAAGGGCTCTCTGAAGAAATGCTACTTGAAGA<br>TACCAGCCCTACCAAGGGCAGGGAGAGGACCCTATAGAGGCCT<br>GGGACAGGAGCTCAATGAGAAAGG |
| 1404 | LHA to RHA of CTX-162 | GAGATGTAAGGAGCTGCTGTGACTTGCTCAAGGCCTTATATCG<br>AGTAAACGGTAGTGCTGGGGCTTAGACGCAGGTGTTCTGATTT<br>ATAGTTCAAAACCTCTATCAATGAGAGAGCAATCTCCTGGTAA<br>TGTGATAGATTTCCCAACTTAATGCCAACATACCATAAACCTCC<br>CATTCTGCTAATGCCCAGCCTAAGTTGGGGAGACCACTCCAGA<br>TTCCAAGATGTACAGTTTGCTTTGCTGGGCCTTTTTCCCATGCC<br>TGCCTTTACTCTGCCAGAGTTATATTGCTGGGGTTTTGAAGAAG<br>ATCCTATTAAATAAAAGAATAAGCAGTATTATTAAGTAGCCCT<br>GCATTTCAGGTTTCCTTGAGTGGCAGGCCAGGCCTGGCCGTGA<br>ACGTTCACTGAAATCATGGCCTCTTGGCCAAGATTGATAGCTTG<br>TGCCTGTCCCTGAGTCCCAGTCCATCACGAGCAGCTGGTTTCTA<br>AGATGCTATTTCCCGTATAAAGCATGAGACCGTGACTTGCCAG<br>CCCCACAGAGCCCCGCCCTTGTCCATCACTGGCATCTGGACTCC<br>AGCCTGGGTTGGGGCAAAGAGGGAAATGAGATCATGTCCTAAC<br>CCTGATCCTCTTGTCCCACAGATATCCAGAACCCTGACCCTGCC<br>GTGTACCAGCTGAGAGACTCTAAATCCAGTGACAAGTCTGTCT<br>GCCTATTCACCGATTTTGATTCTCAAACAAATGTGTCACAAAGT<br>AAGGATTCTGATGTGTATATCACAGACAAAACTGTGCTAGACA<br>TGAGGTCTATGGACTTCAGGCTCCGGTGCCCGTCAGTGGGCAG<br>AGCGCACATCGCCCACAGTCCCCGAGAAGTTGGGGGGAGGGG<br>TCGGCAATTGAACCGGTGCCTAGAGAAGGTGGCGCGGGGTAA<br>ACTGGGAAAGTGATGTCGTGTACTGGCTCCGCCTTTTTCCCGAG<br>GGTGGGGGAGAACCGTATATAAGTGCAGTAGTCGCCGTGAACG<br>TTCTTTTTCGCAACGGGTTTGCCGCCAGAACACAGGTAAGTGCC<br>GTGTGTGGTTCCCGCGGGCCTGGCCTCTTTACGGGTTATGCCC<br>TTGCGTGCCTTGAATTACTTCCACTGGCTGCAGTACGTGATTCT<br>TGATCCCGAGCTTCGGGTTGGAAGTGGGTGGGAGAGTTCGAGG<br>CCTTGCGCTTAAGGAGCCCCTTCGCCTCGTGCTTGAGTTGAGGC<br>CTGGCCTGGGCGCTGGGGCCGCCGCGTGCGAATCTGGTGGCAC<br>CTTCGCGCCTGTCTCGCTGCTTTCGATAAGTCTCTAGCCATTTA<br>AAATTTTTGATGACCTGCTGCGACGCTTTTTTTCTGGCAAGATA<br>GTCTTGTAAATGCGGGCCAAGATCTGCACACTGGTATTTCGGTT<br>TTTGGGGCCGCGGGCGGCGACGGGGCCCGTGCGTCCCAGCGCA<br>CATGTTCGGCGAGGCGGGGCCTGCGAGCGCGGCCACCGAGAAT<br>CGGACGGGGGTAGTCTCAAGCTGGCCGGCCTGCTCTGGTGCCT<br>GGCCTCGCGCCGCCGTGTATCGCCCCGCCCTGGGCGGCAAGGC<br>TGGCCCGGTCGGCACCCAGTTGCGTGAGCGGAAAGATGGCCGCT<br>TCCCGGCCCTGCTGCAGGGAGCTCAAAATGGAGGACGCGGCGC<br>TCGGGAGAGCGGGCGGGTGAGTCACCCACACAAAGGAAAAGG<br>GCCTTTCCGTCCTCAGCCGTCGCTTCATGTGACTCCACGGAGTA<br>CCGGGCGCCGTCCAGGCACCTCGATTAGTTCTCGAGCTTTTGGA<br>GTACGTCGTCTTTAGGTTGGGGGGAGGGGTTTTATGCGATGGA<br>GTTTCCCCACACTGAGTGGGTGGAGACTGAAGTTAGGCCAGCT<br>TGGCACTTGATGTAATTCTCCTTGGAATTTGCCCTTTTTGAGTTT<br>GGATCTTGGTTCATTCTCAAGCCTCAGACAGTGGTTCAAAGTTT<br>TTTTCTTCCATTTCAGGTGTCGTGACCACCATGGCGCTTCCGGT<br>GACAGCACTGCTCCTCCCCTTGGCGCTGTTGCTCCACGCAGCAA<br>GGCCGGACATCCAGATGACCCAGAGCCCTAGCAGCCTGAGCGC<br>TAGCGTGGGCGACAGGGTGACCATCACCTGCAGGGCCAGCCAG<br>AGCGTGGACTCCAACGTGGCCTGGTACCAGCAGAAGCCCGAGA<br>AGGCCCCCAAGAGCCTGATCTTCAGCGCCAGCCTGAGGTTCTC<br>CGGAGTGCCTAGCAGATTTAGCGGCAGCGGCAGCGGCACAGA<br>CTTCACCCTGACCATCAGCAGCCTCCAGCCCGAGGATTTCGCC<br>ACCTACTACTGCCAGCAGTACAACTCCTACCCCCTGACCTTCGG<br>CGCCGGCACAAAGCTGGAGATCAAGGGAGGAGGAGGAAGCGG<br>AGGAGGAGGAAGCGGAGGCGGAGGAAGCGAGGTGCAGCTGGT<br>GGAGTCCGGAGGAGGCCTGGTGCAACCTGGAGGCAGCCTGAA<br>GCTGAGCTGTGCCGCCAGCGGAATCGACTTCAGCAGGTACTGG<br>ATGTCCTGGGTGAGACAGGCCCCTGGCAAGGGCTGGAGTGGA<br>TCGGAGAGATCAACCCCGACAGCTCCACCATCAACTACGCCGA<br>CAGCGTGAAGGGCAGGTTCACCATCAGCAGAGACAACGCCAA<br>GAACACCCTGTACCTGCAGATGAACCTGTCCAGAGCCGAGGAC<br>ACCGCCCTGTACTACTGCGCCAGCCTGTATTACGACTACGGCG<br>ACGCTATGGACTACTGGGGCCAGGGCACCCTGGTGACAGTGAG<br>CAGCAGTGCTGCTGCCTTTGTCCCGGTATTTCTCCCAGCCAAAC |

TABLE 35-continued

Donor Template Nucleotide Sequences-Left Homology Arm to Right Homology Arm

| SEQ ID NO: | Description | Sequence |
|---|---|---|
| | | CGACCACGACTCCCGCCCCGCGCCCTCCGACACCCGCTCCCAC
CATCGCCTCTCAACCTCTTAGTCTTCGCCCCGAGGCATGCCGAC
CCGCCGCCGGGGGTGCTGTTCATACGAGGGGCTTGGACTTCGC
TTGTGATATTTACATTTGGGCTCCGTTGGCGGGTACGTGCGGCG
TCCTTTTGTTGTCACTCGTTATTACTTTGTATTGTAATCACAGGA
ATCGCTCAAAGCGGAGTAGGTTGTTGCATTCCGATTACATGAA
TATGACTCCTCGCCGGCCTGGGCCGACAAGAAAACATTACCAA
CCCTATGCCCCCCCACGAGACTTCGCTGCGTACAGGTCCCGAG
TGAAGTTTTCCCGAAGCGCAGACGCTCCGGCATATCAGCAAGG
ACAGAATCAGCTGTATAACGAACTGAATTTGGGACGCCGCGAG
GAGTATGACGTGCTTGATAAACGCCGGGGAGAGACCCGGAA
ATGGGGGGTAAACCCCGAAGAAAGAATCCCCAAGAAGGACTC
TACAATGAACTCCAGAAGGATAAGATGGCGGAGGCCTACTCAG
AAATAGGTATGAAGGGCGAACGACGACGGGGAAAAGGTCACG
ATGGCCTCTACCAAGGGTTGAGTACGGCAACCAAAGATACGTA
CGATGCACTGCATATGCAGGCCCTGCCTCCCAGATAATAATAA
AATCGCTATCCATCGAAGATGGATGTGTGTTGGTTTTTTGTGTG
TGGAGCAACAAATCTGACTTTGCATGTGCAAACGCCTTCAACA
ACAGCATTATTCCAGAAGACACCTTCTTCCCCAGCCCAGGTAA
GGGCAGCTTTGGTGCCTTCGCAGGCTGTTTCCTTGCTTCAGGAA
TGGCCAGGTTCTGCCCAGAGCTCTGGTCAATGATGTCTAAAAC
TCCTCTGATTGGTGGTCTCGGCCTTATCCATTGCCACCAAAACC
CTCTTTTTACTAAGAAACAGTGAGCCTTGTTCTGGCAGTCCAGA
GAATGACACGGGAAAAAAGCAGATGAAGAGAAGGTGGCAGGA
GAGGGCACGTGGCCCAGCCTCAGTCTCTCCAACTGAGTTCCTG
CCTGCCTGCCTTTGCTCAGACTGTTTGCCCCTTACTGCTCTTCTA
GGCCTCATTCTAAGCCCCTTCTCCAAGTTGCCTCTCCTTATTTCT
CCCTGTCTGCCAAAAAATCTTTCCCAGCTCACTAAGTCAGTCTC
ACGCAGTCACTCATTAACCCACCAATCACTGATTGTGCCGGCA
CATGAATGCACCAGGTGTTGAAGTGGAGGAATTAAAAAGTCAG
ATGAGGGGTGTGCCCAGAGGAAGCACCATTCTAGTTGGGGGAG
CCCATCTGTCAGCTGGGAAAAGTCCAAATAACTTCAGATTGGA
ATGTGTTTTAACTCAGGGTTGAGAAAACAGCTACCTTCAGGAC
AAAAGTCAGGGAAGGGCTCTCTGAAGAAATGCTACTTGAAGAT
ACCAGCCCTACCAAGGGCAGGGAGAGGACCCTATAGAGGCCT
GGGACAGGAGCTCAATGAGAAAGG |
| 1405 | LHA to RHA of CTX-163 | GAGATGTAAGGAGCTGCTGTGACTTGCTCAAGGCCTTATATCG
AGTAAACGGTAGTGCTGGGGCTTAGACGCAGGTGTTCTGATTT
ATAGTTCAAAACCTCTATCAATGAGAGCAATCTCCTGGTAA
TGTGATAGATTTCCCAACTTAATGCCAACATACCATAAACCTCC
CATTCTGCTAATGCCCAGCCTAAGTTGGGGAGACCACTCCAGA
TTCCAAGATGTACAGTTTGCTTTGCTGGGCCTTTTTCCCATGCC
TGCCTTTACTCTGCCAGAGTTATATTGCTGGGGTTTTGAAGAAG
ATCCTATTAAATAAAAGAATAAGCAGTATTATTAAGTAGCCCT
GCATTTCAGGTTTCCTTGAGTGGCAGGCCAGGCCTGGCCGTGA
ACGTTCACTGAAATCATGGCCTCTTGGCCAAGATTGATAGCTTG
TGCCTGTCCCTGAGTCCCAGTCCATCACGAGCAGCTGGTTTCTA
AGATGCTATTTCCCGTATAAAGCATGAGACCGTGACTTGCCAG
CCCCACAGAGCCCCGCCCTTGTCCATCACTGGCATCTGGACTCC
AGCCTGGGTTGGGCAAAGAGGGAAATGAGATCATGTCCTAAC
CCTGATCCTCTTGTCCCACAGATATCCAGAACCCTGACCCTGCC
GTGTACCAGCTGAGAGACTCTAAATCCAGTGACAAGTCTGTCT
GCCTATTCACCGATTTTGATTCTCAAACAAATGTGTCACAAAGT
AAGGATTCTGATGTGTATATCACAGACAAAACTGTGCTAGACA
TGAGGTCTATGGACTTCAGGCTCCGGTGCCCGTCAGTGGGCAG
AGCGCACATCGCCCACAGTCCCCGAGAAGTTGGGGGGAGGGG
TCGGCAATTGAACCGGTGCCTAGAGAAGGTGGCGCGGGGTAA
ACTGGGAAAGTGATGTCGTGTACTGGCTCCGCCTTTTTCCCGAG
GGTGGGGGAGAACCGTATATAAGTGCAGTAGTCGCCGTGAACG
TTCTTTTTCGCAACGGGTTTGCCGCCAGAACACAGGTAAGTGCC
GTGTGTGGTTCCCGCGGGCCTGGCCTCTTTTACGGGTTATGCCC
TTGCGTGCCTTGAATTACTTCCACTGGCTGCAGTACGTGATTCT
TGATCCCGAGCTTCGGGTTGGAAGTGGGTGGGAGAGTTCGAGG
CCTTGCGCTTAAGGAGCCCCTTCGCCTCGTGCTTGAGTTGAGGC
CTGGCCTGGGCGCTGGGGCGCCGCGTGCGAATCTGGTGGCAC
CTTCGCGCCTGTCTCGCTGCTTTCGATAAGTCTCTAGCCATTTA
AAATTTTTGATGACCTGCTGCGACGCTTTTTTCTGGCAAGATA
GTCTTGTAAATGCGGGCCAAGATCTGCACACTGGTATTTCGGTT
TTTGGGGCCGCGGGCGGCGACGGGGCCCGTGCGTCCCAGCGCA
CATGTTCGGCGAGGCGGGGCCTGCGAGCGCGGCCACCGAGAAT
CGGACGGGGGTAGTCTCAAGCTGGCCGGCCTGCTCTGGTGCCT
GGCCTCGCGCCGCCGTGTATCGCCCCGCCCTGGGCGGCAAGGC
TGGCCCGGTCGGCACCAGTTGCGTGAGCGGAAAGATGGCCGCT
TCCCGGCCCTGCTGCAGGGAGCTCAAAATGGAGGACGCGGCGC |

TABLE 35-continued

Donor Template Nucleotide Sequences-Left Homology Arm to Right Homology Arm

| SEQ ID NO: | Description | Sequence |
|---|---|---|
| | | TCGGGAGAGCGGGCGGGTGAGTCACCCACACAAAGGAAAAGG<br>GCCTTTCCGTCCTCAGCCGTCGCTTCATGTGACTCCACGGAGTA<br>CCGGGCGCCGTCCAGGCACCTCGATTAGTTCTCGAGCTTTTGGA<br>GTACGTCGTCTTTAGGTTGGGGGGAGGGGTTTTATGCGATGGA<br>GTTTCCCCACACTGAGTGGGTGGAGACTGAAGTTAGGCCAGCT<br>TGGCACTTGATGTAATTCTCCTTGGAATTTGCCCTTTTTGAGTTT<br>GGATCTTGGTTCATTCTCAAGCCTCAGACAGTGGTTCAAAGTTT<br>TTTTCTTCCATTTCAGGTGTCGTGACCACCATGGCGCTTCCGGT<br>GACAGCACTGCTCCTCCCCTTGGCGCTGTTGCTCCACGCAGCAA<br>GGCCGGACATCCAAATGACCCAGTCCCCTAGCAGCCTGTCCGC<br>CAGCCCTGGAGACAGGGTGTCCGTGACCTGCAAGGCCAGCCAG<br>TCCGTGGACAGCAACGTCGCCTGGTATCAGCAGAAGCCCAGGC<br>AAGCTCCCAAGGCTCTGATCTTCTCCGCCAGCCTGAGATTTTCC<br>GGCGTGCCCGCCAGATTCACCGGAAGCGGCAGCGGCACCGACT<br>TCACCCTGACCATCAGCAACCTGCAGAGCGAGGATTTCGCCAC<br>ATACTACTGCCAGCAGTACAACAACTACCCCCTGACCTTCGGA<br>GCCGGCACCAAGCTGGAGATCAAAGGCGGCGGAGGCAGCGGC<br>GGCGGCGGCAGCGGCGGAGGCGGATCCGAAGTGCAGCTGGTG<br>GAAAGCGGAGGCGGACTCGTGCAGCCTGGCGGAAGCCTGAAG<br>CTGAGCTGTGCCGCCAGCGGCATCGACTTCAGCAGGTACTGGA<br>TGAGCTGGGTGAGGCAGGCTCCCGGCAAAGGCCTGGAGTGGAT<br>CGGCGAGATCAACCCTGACAGCAGCACCATCAACTACGCCGAC<br>AGCGTGAAAGGCAGGTTCACCATCAGCAGGGACAACGCCAAG<br>AACACCCTGTACCTGCAGATGAACCTGTCCAGAGCCGAGGACA<br>CCGCCCTGTACTACTGCGCCAGCCTGTACTACGACTACGGCGA<br>CGCTATGGACTACTGGGGCCAAGGCACCCTCGTGACCGTCAGC<br>TCCAGTGCTGCTGCCTTTGTCCCGGTATTTCTCCCAGCCAAACC<br>GACCACGACTCCCGCCCCGCGCCCTCCGACACCCGCTCCCACC<br>ATCGCCTCTCAACCTCTTAGTCTTCGCCCCGAGGCATGCCGACC<br>CGCCGCCGGGGGTGCTGTTCATACGAGGGGCTTGGACTTCGCT<br>TGTGATATTTACATTTGGGCTCCGTTGGCGGGTACGTGCGGCGT<br>CCTTTTGTTGTCACTCGTTATTACTTTGTATTGTAATCACAGGAA<br>TCGCTCAAAGCGGAGTAGGTTGTTGCATTCCGATTACATGAAT<br>ATGACTCCTCGCCGGCCTGGGCCGACAAGAAAACATTACCAAC<br>CCTATGCCCCCCACGAGACTTCGCTGCGTACAGGTCCCGAGT<br>GAAGTTTTCCCGAAGCGCAGACGCTCCGGCATATCAGCAAGGA<br>CAGAATCAGCTGTATAACGAACTGAATTTGGGACGCCGCGAGG<br>AGTATGACGTGCTTGATAAACGCCGGGGAGAGACCCGGAAA<br>TGGGGGGTAAACCCCGAAGAAAGAATCCCCAAGAAGGACTCT<br>ACAATGAACTCCAGAAGGATAAGATGGCGGAGGCCTACTCAG<br>AAATAGGTATGAAGGGCGAACGACGACGGGGAAAAGGTCACG<br>ATGGCCTCTACCAAGGGTTGAGTACGGCAACCAAAGATACGTA<br>CGATGCACTGCATATGCAGGCCCTGCCTCCCAGATAATAATAA<br>AATCGCTATCCATCGAAGATGGATGTGTGTTGGTTTTTTGTGTG<br>TGGAGCAACAAATCTGACTTTGCATGTGCAAACGCCTTCAACA<br>ACAGCATTATTCCAGAAGACACCTTCTTCCCCAGCCCAGGTAA<br>GGGCAGCTTTGGTGCCTTCGCAGGCTGTTTCCTTGCTTCAGGAA<br>TGGCCAGGTTCTGCCCAGAGCTCTGGTCAATGATGTCTAAAAC<br>TCCTCTGATTGGTGGTCTCGGCCTTATCCATTGCCACCAAAACC<br>CTCTTTTTACTAAGAAACAGTGAGCCTTGTTCTGGCAGTCCAGA<br>GAATGACACGGGAAAAAAGCAGATGAAGAGAAGGTGGCAGGA<br>GAGGGCACGTGGCCCAGCCTCAGTCTCTCCAACTGAGTTCCTG<br>CCTGCCTGCCTTTGCTCAGACTGTTTGCCCCTTACTGCTCTTCTA<br>GGCCTCATTCTAAGCCCCTTCTCCAAGTTGCCTCTCCTTATTTCT<br>CCCTGTCTGCCAAAAAATCTTTCCCAGCTCACTAAGTCAGTCTC<br>ACGCAGTCACTCATTAACCCACCAATCACTGATTGTGCCGGCA<br>CATGAATGCACCAGGTGTTGAAGTGGAGGAATTAAAAAGTCAG<br>ATGAGGGTGTGCCCAGAGGAAGCACCATTCTAGTTGGGGGAG<br>CCCATCTGTCAGCTGGGAAAAGTCCAAATAACTTCAGATTGGA<br>ATGTGTTTAACTCAGGGTTGAGAAAACAGCTACCTTCAGGAC<br>AAAAGTCAGGGAAGGGCTCTCTGAAGAAATGCTACTTGAAGAT<br>ACCAGCCCTACCAAGGGCAGGGAGGGACCCTATAGAGGCCT<br>GGGACAGGAGCTCAATGAGAAAGG |
| 1406 | LHA to RHA of<br>CTX-164 | GAGATGTAAGGAGCTGCTGTGACTTGCTCAAGGCCTTATATCG<br>AGTAAACGGTAGTGCTGGGGCTTAGACGCAGGTGTTCTGATTT<br>ATAGTTCAAAACCTCTATCAATGAGAGAGCAATCTCCTGGTAA<br>TGTGATAGATTTCCCAACTTAATGCCAACATACCATAAACCTCC<br>CATTCTGCTAATGCCCAGCCTAAGTTGGGGAGACCACTCCAGA<br>TTCCAAGATGTACAGTTTGCTTTGCTGGGCCTTTTTCCCATGCC<br>TGCCTTTACTCTGCCAGAGTTATATTGCTGGGGTTTTGAAGAAG<br>ATCCTATTAAATAAAAGAATAAGCAGTATTATTAAGTAGCCCT<br>GCATTTCAGGTTTCCTTGAGTGGCAGGCCAGGCCTGGCCGTGA<br>ACGTTCACTGAAATCATGGCCTCTTGGCCAAGATTGATAGCTTG<br>TGCCTGTCCCTGAGTCCCAGTCCATCACGAGCAGCTGGTTTCTA |

TABLE 35-continued

Donor Template Nucleotide Sequences-Left Homology Arm to Right Homology Arm

| SEQ ID NO: | Description | Sequence |
|---|---|---|
| | | AGATGCTATTTCCCGTATAAAGCATGAGACCGTGACTTGCCAG
CCCCACAGAGCCCCGCCCTTGTCCATCACTGGCATCTGGACTCC
AGCCTGGGTTGGGGCAAAGAGGGAAATGAGATCATGTCCTAAC
CCTGATCCTCTTGTCCCACAGATATCCAGAACCCTGACCCTGCC
GTGTACCAGCTGAGAGACTCTAAATCCAGTGACAAGTCTGTCT
GCCTATTCACCGATTTTGATTCTCAAACAAATGTGTCACAAAGT
AAGGATTCTGATGTGTATATCACAGACAAAACTGTGCTAGACA
TGAGGTCTATGGACTTCAGGCTCCGGTGCCCGTCAGTGGGCAG
AGCGCACATCGCCCACAGTCCCCGAGAAGTTGGGGGGAGGGG
TCGGCAATTGAACCGGTGCCTAGAGAAGGTGGCGCGGGGTAA
ACTGGGAAAGTGATGTCGTGTACTGGCTCCGCCTTTTTCCCGAG
GGTGGGGGAGAACCGTATATAAGTGCAGTAGTCGCCGTGAACG
TTCTTTTTCGCAACGGGTTTGCCGCCAGAACACAGGTAAGTGCC
GTGTGTGGTTCCCGCGGGCCTGGCCTCTTTACGGGTTATGCCC
TTGCGTGCCTTGAATTACTTCCACTGGCTGCAGTACGTGATTCT
TGATCCCGAGCTTCGGGTTGGAAGTGGGTGGGAGAGTTCGAGG
CCTTGCGCTTAAGGAGCCCCTTCGCCTCGTGCTTGAGTTGAGGC
CTGGCCTGGGCGCTGGGGCCGCCGCGTGCGAATCTGGTGGCAC
CTTCGCGCCTGTCTCGCTGCTTTCGATAAGTCTCTAGCCATTTA
AAATTTTTGATGACCTGCTGCGACGCTTTTTTTCTGGCAAGATA
GTCTTGTAAATGCGGGCCAAGATCTGCACACTGGTATTTCGGTT
TTTGGGGCCGCGGGCGGCGACGGGGCCCGTGCGTCCCAGCGCA
CATGTTCGGCGAGGCGGGGCCTGCGAGCGCGGCCACCGAGAAT
CGGACGGGGGTAGTCTCAAGCTGGCCGGCCTGCTCTGGTGCCT
GGCCTCGCGCCGCCGTGTATCGCCCCGCCCTGGGCGGCAAGGC
TGGCCCGGTCGGCACCAGTTGCGTGAGCGGAAAGATGGCCGCT
TCCCGGCCCTGCTGCAGGGAGCTCAAATGGAGGACGCGGCGC
TCGGGAGAGCGGGCGGGTGAGTCACCCACACAAAGGAAAAGG
GCCTTTCCGTCCTCAGCCGTCGCTTCATGTGACTCCACGGAGTA
CCGGGCGCCGTCCAGGCACCTCGATTAGTTCTCGAGCTTTTGGA
GTACGTCGTCTTTAGGTTGGGGGGAGGGGTTTTATGCGATGGA
GTTTCCCCACACTGAGTGGGTGGAGACTGAAGTTAGGCCAGCT
TGGCACTTGATGTAATTCTCCTTGGAATTTGCCCTTTTTGAGTTT
GGATCTTGGTTCATTCTCAAGCCTCAGACAGTGGTTCAAAGTTT
TTTTCTTCCATTTCAGGTGTCGTGACCACCATGGCGCTTCCGGT
GACAGCACTGCTCCTCCCCTTGGCGCTGTTGCTCCACGCAGCAA
GGCCGGAGGTGCAGCTGCAGCAGTCCGGCCCTGAGCTCGTGAA
GCCTGGAGCCAGCGTGAAAATGAGCTGTAAGGCCTCCGGCAAC
ACCCTCACCAACTACGTGATCCATTGGATGAAGCAGATGCCCG
GCCAGGGCCTGGACTGGATTGGCTACATTCTGCCCTACAACGA
CCTGACCAAGTACAACGAGAAGTTCACCGGCAAGGCCACCCTG
ACCAGCGATAAGAGCTCCAGCAGCGCCTACATGGAGCTGAACT
CCCTGACCAGCGAGGACAGCGCCGTGTACTACTGCACCAGGTG
GGACTGGGATGGCTTCTTCGACCCCTGGGGACAGGGCACCACC
CTGACAGTGTCCAGCGGAGGAGGCGGCAGCGGCGGCGGCGGC
TCCGGCGGCGGCGGCAGCGATATCGTGATGACACAGTCCCCTC
TGAGCCTGCCTGTGAGCCTGGGCGACCAGGCCAGCATCAGCTG
CAGGTCCACCCAGTCCCTGGTGCACTCCAACGGCAACACCCAC
CTGCACTGGTACCTGCAAAGGCCCGGCCAGTCCCCTAAGCTGC
TGATCTACAGCGTGAGCAACAGGTTTAGCGAGGTGCCCGATAG
ATTTTCCGCCAGCGGCAGCGGCACCGACTTCACACTGAAGATC
TCCAGGGTGGAGGCCGAGGATCTGGGCGTGTACTTCTGCAGCC
AGACCAGCCACATCCCCTACACCTTCGGCGGCGGAACCAAGCT
GGAGATCAAGAGTGCTGCTGCCTTTGTCCCGGTATTTCTCCCAG
CCAAACCGACCACGACTCCCGCCCCGCGCCCTCCGACACCCGC
TCCCACCATCGCCTCTCAACCTCTTAGTCTTCGCCCCGAGGCAT
GCCGACCCGCCGCCGGGGGTGCTGTTCATACGAGGGGCTTGGA
CTTCGCTTGTGATATTTACATTTGGGCTCCGTTGGCGGGTACGT
GCGGCGTCCTTTTGTTGTCACTCGTTATTACTTTGTATTGTAATC
ACAGGAATCGCTCAAAGCGGAGTAGGTTGTTGCATTCCGATTA
CATGAATATGACTCCTCGCCGGCCTGGGCCGACAAGAAAACAT
TACCAACCCTATGCCCCCCCACGAGACTTCGCTGCGTACAGGT
CCCGAGTGAAGTTTTCCCGAAGCGCAGACGCTCCGGCATATCA
GCAAGGACAGAATCAGCTGTATAACGAACTGAATTTGGGACGC
CGCGAGGAGTATGACGTGCTTGATAAACGCCGGGGAGAGAC
CCGGAAATGGGGGTAAACCCCGAAGAAAGAATCCCCAAGAA
GGACTCTACAATGAACTCCAGAAGGATAAGATGGCGGAGGCCT
ACTCAGAAATAGGTATGAAGGGCGAACGACGACGGGGAAAAG
GTCACGATGGCCTCTACCAAGGGTTGAGTACGGCAACCAAAGA
TACGTACGATGCACTGCATATGCAGGCCCTGCCTCCCAGATAA
TAATAAAATCGCTATCCATCGAAGATGGATGTGTGTTGGTTTTT
TGTGTGTGGAGCAACAAATCTGACTTTGCATGTGCAAACGCCT
TCAACAACAGCATTATTCCAGAAGACACCTTCTTCCCCAGCCC
AGGTAAGGGCAGCTTTGGTGCCTTCGCAGGCTGTTTCCTTGCTT
CAGGAATGGCCAGGTTCTGCCCAGAGCTCTGGTCAATGATGTC |

TABLE 35-continued

Donor Template Nucleotide Sequences-Left Homology Arm to Right Homology Arm

| SEQ ID NO: | Description | Sequence |
|---|---|---|
| | | TAAAACTCCTCTGATTGGTGGTCTCGGCCTTATCCATTGCCACC<br>AAAACCCTCTTTTTACTAAGAAACAGTGAGCCTTGTTCTGGCAG<br>TCCAGAGAATGACACGGGAAAAAAGCAGATGAAGAGAAGGTG<br>GCAGGAGAGGGCACGTGGCCCAGCCTCAGTCTCTCCAACTGAG<br>TTCCTGCCTGCCTGCCTTTGCTCAGACTGTTTGCCCCTTACTGCT<br>CTTCTAGGCCTCATTCTAAGCCCCTTCTCCAAGTTGCCTCTCCTT<br>ATTTCTCCCTGTCTGCCAAAAAATCTTTCCCAGCTCACTAAGTC<br>AGTCTCACGCAGTCACTCATTAACCCACCAATCACTGATTGTGC<br>CGGCACATGAATGCACCAGGTGTTGAAGTGGAGGAATTAAAA<br>AGTCAGATGAGGGGTGTGCCCAGAGGAAGCACCATTCTAGTTG<br>GGGGAGCCCATCTGTCAGCTGGGAAAAGTCCAAATAACTTCAG<br>ATTGGAATGTGTTTTAACTCAGGGTTGAGAAAACAGCTACCTT<br>CAGGACAAAAGTCAGGGAAGGGCTCTCTGAAGAAATGCTACTT<br>GAAGATACCAGCCCTACCAAGGGCAGGGAGAGGACCCTATAG<br>AGGCCTGGGACAGGAGCTCAATGAGAAAGG |
| 1407 | LHA to RHA<br>CTX-165 | GAGATGTAAGGAGCTGCTGTGACTTGCTCAAGGCCTTATATCG<br>AGTAAACGGTAGTGCTGGGGCTTAGACGCAGGTGTTCTGATTT<br>ATAGTTCAAAACCTCTATCAATGAGAGAGCAATCTCCTGGTAA<br>TGTGATAGATTTCCCAACTTAATGCCAACATACCATAAACCTCC<br>CATTCTGCTAATGCCCAGCCTAAGTTGGGGAGACCACTCCAGA<br>TTCCAAGATGTACAGTTTGCTTTGCTGGGCCTTTTTCCCATGCC<br>TGCCTTTACTCTGCCAGAGTTATATTGCTGGGGTTTTGAAGAAG<br>ATCCTATTAAATAAAAGAATAAGCAGTATTATTAAGTAGCCCT<br>GCATTTCAGGTTTCCTTGAGTGGCAGGCCAGGCCTGGCCGTGA<br>ACGTTCACTGAAATCATGGCCTCTTGGCCAAGATTGATAGCTTG<br>TGCCTGTCCCTGAGTCCCAGTCCATCACGAGCAGCTGGTTTCTA<br>AGATGCTATTTCCCGTATAAAGCATGAGACCGTGACTTGCCAG<br>CCCCACAGAGCCCCGCCCTTGTCCATCACTGGCATCTGGACTCC<br>AGCCTGGGTTGGGCAAAGAGGGAAATGAGATCATGTCCTAAC<br>CCTGATCCTCTTGTCCCACAGATATCCAGAACCCTGACCCTGCC<br>GTGTACCAGCTGAGAGACTCTAAATCCAGTGACAAGTCTGTCT<br>GCCTATTCACCGATTTTGATTCTCAAACAAATGTGTCACAAAGT<br>AAGGATTCTGATGTGTATATCACAGACAAAACTGTGCTAGACA<br>TGAGGTCTATGGACTTCAGGCTCCGGTGCCCGTCAGTGGGCAG<br>AGCGCACATCGCCCACAGTCCCCGAGAAGTTGGGGGGAGGGG<br>TCGGCAATTGAACCGGTGCCTAGAGAAGGTGGCGCGGGGTAA<br>ACTGGGAAAGTGATGTCGTGTACTGGCTCCGCCTTTTTCCCGAG<br>GGTGGGGGAGAACCGTATATAAGTGCAGTAGTCGCCGTGAACG<br>TTCTTTTTCGCAACGGGTTTGCCGCCAGAACACAGGTAAGTGCC<br>GTGTGTGGTTCCCGCGGGCCTGGCCTCTTTACGGGTTATGCCC<br>TTGCGTGCCTTGAATTACTTCCACTGGCTGCAGTACGTGATTCT<br>TGATCCCGAGCTTCGGGTTGGAAGTGGGTGGGAGAGTTCGAGG<br>CCTTGCGCTTAAGGAGCCCCTTCGCCTCGTGCTTGAGTTGAGGC<br>CTGGCCTGGGCGCTGGGGCCGCCGCGTGCGAATCTGGTGGCAC<br>CTTCGCGCCTGTCTCGCTGCTTTCGATAAGTCTCTAGCCATTTA<br>AAATTTTTGATGACCTGCTGCGACGCTTTTTTTCTGGCAAGATA<br>GTCTTGTAAATGCGGGCCAAGATCTGCACACTGGTATTTCGGTT<br>TTTGGGGCCGCGGGCGGCGACGGGGCCCGTGCGTCCCAGCGCA<br>CATGTTCGGCGAGGCGGGCCTGCGAGCGCGGCCACCGAGAAT<br>CGGACGGGGGTAGTCTCAAGCTGGCCGGCCTGCTCTGGTGCCT<br>GGCCTCGCGCCGCCGTGTATCGCCCCGCCCTGGGCGGCAAGGC<br>TGGCCCGGTCGGCACCAGTTGCGTGAGCGGAAAGATGGCCGCT<br>TCCCGGCCCTGCTGCAGGGAGCTCAAAATGGAGGACGCGGCGC<br>TCGGGAGAGCGGGCGGGTGAGTCACCCACACAAAGGAAAAGG<br>GCCTTTCCGTCCTCAGCCGTCGCTTCATGTGACTCCACGGAGTA<br>CCGGGCGCCGTCCAGGCACCTCGATTAGTTCTCGAGCTTTTGGA<br>GTACGTCGTCTTTAGGTTGGGGGGAGGGGTTTTATGCGATGGA<br>GTTTCCCCACACTGAGTGGGTGGAGACTGAAGTTAGGCCAGCT<br>TGGCACTTGATGTAATTCTCCTTGGAATTTGCCCTTTTTGAGTTT<br>GGATCTTGGTTCATTCTCAAGCCTCAGACAGTGGTTCAAAGTTT<br>TTTTCTTCCATTTCAGGTGTCGTGACCACCATGGCGCTTCCGGT<br>GACAGCACTGCTCCTCCCCTTGGCGCTGTTGCTCCACGCAGCAA<br>GGCCGGACATCGTGATGACCCAGAGCCCCTGAGCCTGCCTGT<br>GTCCCTGGGAGACCAGGCTTCCATCAGCTGCAGGTCCACCCAG<br>AGCCTGGTGCACTCCAACGGCAACACCCACCTGCACTGGTACC<br>TGCAGAGGCCTGGCCAGTCCCCCAAGCTGCTGATCTACAGCGT<br>GAGCAATAGGTTCAGCGAGGTGCCCGACAGATTCAGCGCCAGC<br>GGAAGCGGCACCGACTTCACCCTGAAGATCAGCAGGGTCGAG<br>GCCGAAGATCTGGGCGTGTACTTCTGCTCCCAGCATCCCACA<br>TCCCTTACACCTTCGGCGGCGGCACCAAGCTGGAGATTAAGGG<br>CGGCGGAGGATCCGGCGGAGGAGGATCCGGAGGAGGAGGAAG<br>CGAGGTGCAGCTGCAGCAGAGCGGACCCGAGCTGGTGAAACC<br>CGGAGCCAGCGTCAAAATGAGCTGCAAGGCCAGCGGCAACAC<br>CCTGACCAACTACGTCATCCACTGGATGAAGCAGATGCCCGGA |

TABLE 35-continued

Donor Template Nucleotide Sequences-Left Homology Arm to Right Homology Arm

| SEQ ID NO: | Description | Sequence |
|---|---|---|
|  |  | CAGGGCCTGGACTGGATCGGCTACATCCTGCCCTACAACGACC
TGACCAAGTACAACGAGAAATTCACCGGCAAGGCCACCCTGAC
CAGCGACAAGAGCAGCAGCAGCGCCTACATGGAGCTGAACAG
CCTGACCAGCGAGGACTCCGCCGTGTACTATTGCACCAGGTGG
GACTGGGACGGCTTCTTTGACCCCTGGGGCCAGGGCACAACAC
TCACCGTGAGCTCCAGTGCTGCTGCCTTTGTCCCGGTATTTCTC
CCAGCCAAACCGACCACGACTCCCGCCCCGCGCCCTCCGACAC
CCGCTCCCACCATCGCCTCTCAACCTCTTAGTCTTCGCCCCGAG
GCATGCCGACCCGCCGCCGGGGGTGCTGTTCATACGAGGGGCT
TGGACTTCGCTTGTGATATTTACATTTGGGCTCCGTTGGCGGGT
ACGTGCGGCGTCCTTTTGTTGTCACTCGTTATTACTTTGTATTGT
AATCACAGGAATCGCTCAAAGCGGAGTAGGTTGTTGCATTCCG
ATTACATGAATATGACTCCTCGCCGGCCTGGGCCGACAAGAAA
ACATTACCAACCCTATGCCCCCCCACGAGACTTCGCTGCGTAC
AGGTCCCGAGTGAAGTTTTCCCGAAGCGCAGACGCTCCGGCAT
ATCAGCAAGGACAGAATCAGCTGTATAACGAACTGAATTTGGG
ACGCCGCGAGGAGTATGACGTGCTTGATAAACGCCGGGGGAG
AGACCCGGAAATGGGGGGTAAACCCCGAAGAAAGAATCCCCA
AGAAGGACTCTACAATGAACTCCAGAAGGATAAGATGGCGGA
GGCCTACTCAGAAATAGGTATGAAGGGCGAACGACGACGGGG
AAAAGGTCACGATGGCCTCTACCAAGGGTTGAGTACGGCAACC
AAAGATACGTACGATGCACTGCATATGCAGGCCCTGCCTCCCA
GATAATAATAAAATCGCTATCCATCGAAGATGGATGTGTGTTG
GTTTTTTGTGTGTGGAGCAACAAATCTGACTTTGCATGTGCAAA
CGCCTTCAACAACAGCATTATTCCAGAAGACACCTTCTTCCCCA
GCCCAGGTAAGGGCAGCTTTGGTGCCTTCGCAGGCTGTTTCCTT
GCTTCAGGAATGGCCAGGTTCTGCCCAGAGCTCTGGTCAATGA
TGTCTAAAACTCCTCTGATTGGTGGTCTCGGCCTTATCCATTGC
CACCAAAACCCTCTTTTTACTAAGAAACAGTGAGCCTTGTTCTG
GCAGTCCAGAGAATGACACGGGAAAAAAGCAGATGAAGAGAA
GGTGGCAGGAGAGGGCACGTGGCCCAGCCTCAGTCTCTCCAAC
TGAGTTCCTGCCTGCCTGCCTTTGCTCAGACTGTTTGCCCCTTA
CTGCTCTTCTAGGCCTCATTCTAAGCCCCTTCTCCAAGTTGCCT
CTCCTTATTTCTCCCTGTCTGCCAAAAAATCTTTCCCAGCTCACT
AAGTCAGTCTCACGCAGTCACTCATTAACCCACCAATCACTGA
TTGTGCCGGCACATGAATGCACCAGGTGTTGAAGTGGAGGAAT
TAAAAAGTCAGATGAGGGGTGTGCCCAGAGGAAGCACCATTCT
AGTTGGGGGAGCCCATCTGTCAGCTGGGAAAAGTCCAAATAAC
TTCAGATTGGAATGTGTTTTAACTCAGGGTTGAGAAAACAGCT
ACCTTCAGGACAAAAGTCAGGGAAGGGCTCTCTGAAGAAATGC
TACTTGAAGATACCAGCCCTACCAAGGGCAGGGAGGAGGACCCT
ATAGAGGCCTGGGACAGGAGCTCAATGAGAAAGG |
| 1408 | LHA to RHA of CTX-166 | GAGATGTAAGGAGCTGCTGTGACTTGCTCAAGGCCTTATATCG
AGTAAACGGTAGTGCTGGGGCTTAGACGCAGGTGTTCTGATTT
ATAGTTCAAAACCTCTATCAATGAGAGAGCAATCTCCTGGTAA
TGTGATAGATTTCCCAACTTAATGCCAACATACCATAAACCTCC
CATTCTGCTAATGCCCAGCCTAAGTTGGGGAGACCACTCCAGA
TTCCAAGATGTACAGTTTGCTTTGCTGGGCCTTTTTCCCATGCC
TGCCTTTACTCTGCCAGAGTTATATTGCTGGGGTTTTGAAGAAG
ATCCTATTAAATAAAAGAATAAGCAGTATTATTAAGTAGCCCT
GCATTTCAGGTTTCCTTGAGTGGCAGGCCAGGCCTGGCCGTGA
ACGTTCACTGAAATCATGGCCTCTTGGCCAAGATTGATAGCTTG
TGCCTGTCCCTGAGTCCCAGTCCATCACGAGCAGCTGGTTTCTA
AGATGCTATTTCCCGTATAAAGCATGAGACCGTGACTTGCCAG
CCCCACAGAGCCCCGCCCTTGTCCATCACTGGCATCTGGACTCC
AGCCTGGGTTGGGGCAAAGAGGGAAATGAGATCATGTCCTAAC
CCTGATCCTCTTGTCCCACAGATATCCAGAACCCTGACCCTGCC
GTGTACCAGCTGAGAGACTCTAAATCCAGTGACAAGTCTGTCT
GCCTATTCACCGATTTTGATTCTCAAACAAATGTGTCACAAAGT
AAGGATTCTGATGTGTATATCACAGACAAAACTGTGCTAGACA
TGAGGTCTATGGACTTCAGGCTCCGGTGCCCGTCAGTGGGCAG
AGCGCACATCGCCCACAGTCCCCGAGAAGTTGGGGGGAGGGG
TCGGCAATTGAACCGGTGCCTAGAGAAGGTGGCGCGGGGTAA
ACTGGGAAAGTGATGTCGTGTACTGGCTCCGCCTTTTTCCCGAG
GGTGGGGGAGAACCGTATATAAGTGCAGTAGTCGCCGTGAACG
TTCTTTTTCGCAACGGGTTTGCCGCCAGAACACAGGTAAGTGCC
GTGTGTGGTTCCCGCGGGCCTGGCCTCTTTACGGGTTATGGCCC
TTGCGTGCCTTGAATTACTTCCACTGGCTGCAGTACGTGATTCT
TGATCCCGAGCTTCGGGTTGGAAGTGGGTGGGAGAGTTCGAGG
CCTTGCGCTTAAGGAGCCCCTTCGCCTCGTGCTTGAGTTGAGGC
CTGGCCTGGGCGCTGGGGCCGCCGCGTGCGAATCTGGTGGCAC
CTTCGCGCCTGTCTCGCTGCTTTCGATAAGTCTCTAGCCATTTA
AAATTTTTGATGACCTGCTGCGACGCTTTTTTTCTGGCAAGATA
GTCTTGTAAATGCGGGCCAAGATCTGCACACTGGTATTTCGGTT |

TABLE 35-continued

Donor Template Nucleotide Sequences-Left Homology Arm to Right Homology Arm

| SEQ ID NO: | Description | Sequence |
|---|---|---|
| | | TTTGGGGCCGCGGGCGGCGACGGGGCCCGTGCGTCCCAGCGCA<br>CATGTTCGGCGAGGCGGGGCCTGCGAGCGCGGCCACCGAGAAT<br>CGGACGGGGGTAGTCTCAAGCTGGCCGGCCTGCTCTGGTGCCT<br>GGCCTCGCGCCGCCGTGTATCGCCCCGCCCTGGGCGGCAAGGC<br>TGGCCCGGTCGGCACCAGTTGCGTGAGCGGAAAGATGGCCGCT<br>TCCCGGCCCTGCTGCAGGGAGCTCAAAATGGAGGACGCGGCGC<br>TCGGGAGAGCGGGCGGGTGAGTCACCCACACAAAGGAAAAGG<br>GCCTTTCCGTCCTCAGCCGTCGCTTCATGTGACTCCACGGAGTA<br>CCGGGCGCCGTCCAGGCACCTCGATTAGTTCTGAGCTTTTGGA<br>GTACGTCGTCTTTAGGTTGGGGGGAGGGGTTTTATGCGATGGA<br>GTTTCCCCACACTGAGTGGGTGGAGACTGAAGTTAGGCCAGCT<br>TGGCACTTGATGTAATTCTCCTTGGAATTTGCCCTTTTTGAGTTT<br>GGATCTTGGTTCATTCTCAAGCCTCAGACAGTGGTTCAAAGTTT<br>TTTTCTTCCATTTCAGGTGTCGTGACCACCATGGCGCTTCCGGT<br>GACAGCACTGCTCCTCCCCTTGGCGCTGTTGCTCCACGCAGCAA<br>GGCCGCAGGTGCAGCTGGTGCAGAGCGGAGCCGAGCTCAAGA<br>AGCCCGGAGCCTCCGTGAAGGTGAGCTGCAAGGCCAGCGGCA<br>ACACCCTGACCAACTACGTGATCCACTGGGTGAGACAAGCCCC<br>CGGCCAAAGGCTGGAGTGGATGGGCTACATCCTGCCCTACAAC<br>GACCTGACCAAGTACAGCCAGAAGTTCCAGGGCAGGGTGACC<br>ATCACCAGGGATAAGAGCGCCTCCACCGCCTATATGGAGCTGA<br>GCAGCCTGAGGAGCGAGGACACCGCTGTGTACTACTGTACAAG<br>GTGGGACTGGGACGGCTTCTTTGACCCCTGGGGCCAGGGCACA<br>ACAGTGACCGTCAGCAGCGGCGGCGGAGGCAGCGGCGGCGGC<br>GGCAGCGGCGGAGGCGGAAGCGAAATCGTGATGACCCAGAGC<br>CCCGCCACACTGAGCGTGAGCCCTGGCGAGAGGGCCAGCATCT<br>CCTGCAGGGCTAGCCAAAGCCTGGTGCACAGCAACGGCAACAC<br>CCACCTGCACTGGTACCAGCAGAGACCCGGACAGGCTCCCAGG<br>CTGCTGATCTACAGCGTGAGCAACAGGTTCTCCGAGGTGCCTG<br>CCAGGTTTAGCGGCAGCGGAAGCGGCACCGACTTTACCCTGAC<br>CATCAGCAGCGTGGAGTCCGAGGACTTCGCCGTGTATTACTGC<br>AGCCAGACCAGCCACATCCCTTACACCTTCGGCGGCGGCACCA<br>AGCTGGAGATCAAAAGTGCTGCTGCCTTTGTCCCGGTATTTCTC<br>CCAGCCAAACCGACCACGACTCCCGCCCCGCGCCCTCCGACAC<br>CCGCTCCCACCATCGCCTCTCAACCTCTTAGTCTTCGCCCCGAG<br>GCATGCCGACCCGCCGCCGGGGGTGCTGTTCATACGAGGGGCT<br>TGGACTTCGCTTGTGATATTTACATTTGGGCTCCGTTGGCGGGT<br>ACGTGCGGCGTCCTTTTGTTGTCACTCGTTATTACTTTGTATTGT<br>AATCACAGGAATCGCTCAAAGCGGAGTAGGTTGTTGCATTCCG<br>ATTACATGAATATGACTCCTCGCCGGCCTGGGCCGACAAGAAA<br>ACATTACCAACCCTATGCCCCCCACGAGACTTCGCTGCGTAC<br>AGGTCCCGAGTGAAGTTTTCCCGAAGCGCAGACGCTCCGGCAT<br>ATCAGCAAGGACAGAATCAGCTGTATAACGAACTGAATTTGGG<br>ACGCCGCGAGGAGTATGACGTGCTTGATAAACGCCGGGGGAG<br>AGACCCGGAAATGGGGGGTAAACCCCGAAGAAAGAATCCCCA<br>AGAAGGACTCTACAATGAACTCCAGAAGGATAAGATGGCGGA<br>GGCCTACTCAGAAATAGGTATGAAGGGCGAACGACGACGGGG<br>AAAAGGTCACGATGGCCTCTACCAAGGGGTTGAGTACGGCAACC<br>AAAGATACGTACGATGCACTGCATATGCAGGCCCTGCCTCCCA<br>GATAATAATAAAATCGCTATCCATCGAAGATGGATGTGTGTTG<br>GTTTTTTGTGTGTGGAGCAACAAATCTGACTTTGCATGTGCAAA<br>CGCCTTCAACAACAGCATTATTCCAGAAGACACCTTCTTCCCCA<br>GCCCAGGTAAGGGCAGCTTTGGTGCCTTCGCAGGCTGTTTCCTT<br>GCTTCAGGAATGGCCAGGTTCTGCCCAGAGCTCTGGTCAATGA<br>TGTCTAAAACTCCTCTGATTGGTGGTCTCGGCCTTATCCATTGC<br>CACCAAAACCCTCTTTTTACTAAGAAACAGTGAGCCTTGTTCTG<br>GCAGTCCAGAGAATGACACGGGAAAAAAGCAGATGAAGAGAA<br>GGTGGCAGGAGAGGGCACGTGGCCCAGCCTCAGTCTCTCCAAC<br>TGAGTTCCTGCCTGCCTGCCTTTGCTCAGACTGTTTGCCCCTTA<br>CTGCTCTTCTAGGCCTCATTCTAAGCCCCTTCTCCAAGTTGCCT<br>CTCCTTATTTCTCCCTGTCTGCCAAAAAATCTTTCCCAGCTCACT<br>AAGTCAGTCTCACGCAGTCACTCATTAACCCACCAATCACTGA<br>TTGTGCCGGCACATGAATGCACCAGGTGTTGAAGTGGAGGAAT<br>TAAAAAGTCAGATGAGGGGTGTGCCCAGAGGAAGCACCATTCT<br>AGTTGGGGGAGCCCATCTGTCAGCTGGGAAAAGTCCAAATAAC<br>TTCAGATTGGAATGTGTTTTAACTCAGGGTTGAGAAAACAGCT<br>ACCTTCAGGACAAAAGTCAGGGAAGGGCTCTCTGAAGAAATGC<br>TACTTGAAGATACCAGCCCTACCAAGGGCAGGGAGAGGACCCT<br>ATAGAGGCCTGGGACAGGAGCTCAATGAGAAAGG |
| 1409 | LHA to RHA of CTX-166b | GAGATGTAAGGAGCTGCTGTGACTTGCTCAAGGCCTTATATCG<br>AGTAAACGGTAGTGCTGGGGCTTAGACGCAGGTGTTCTGATTT<br>ATAGTTCAAAACCTCTATCAATGAGAGCAATCTCCTGGTAA<br>TGTGATAGATTTCCCAACTTAATGCCAACATACCATAAACCTCC<br>CATTCTGCTAATGCCCAGCCTAAGTTGGGGAGACCACTCCAGA |

TABLE 35-continued

Donor Template Nucleotide Sequences-Left Homology Arm to Right Homology Arm

| SEQ ID NO: | Description | Sequence |
|---|---|---|
| | | TTCCAAGATGTACAGTTTGCTTTGCTGGGCCTTTTTCCCATGCC
TGCCTTTACTCTGCCAGAGTTATATTGCTGGGGTTTTGAAGAAG
ATCCTATTAAATAAAAGAATAAGCAGTATTATTAAGTAGCCCT
GCATTTCAGGTTTCCTTGAGTGGCAGGCCAGGCCTGGCCGTGA
ACGTTCACTGAAATCATGGCCTCTTGGCCAAGATTGATAGCTTG
TGCCTGTCCCTGAGTCCCAGTCCATCACGAGCAGCTGGTTTCTA
AGATGCTATTTCCCGTATAAAGCATGAGACCGTGACTTGCCAG
CCCCACAGAGCCCCGCCCTTGTCCATCACTGGCATCTGGACTCC
AGCCTGGGTTGGGGCAAAGAGGGAAATGAGATCATGTCCTAAC
CCTGATCCTCTTGTCCCACAGATATCCAGAACCCTGACCCTGCC
GTGTACCAGCTGAGAGACTCTAAATCCAGTGACAAGTCTGTCT
GCCTATTCACCGATTTTGATTCTCAAACAAATGTGTCACAAAGT
AAGGATTCTGATGTGTATATCACAGACAAAACTGTGCTAGACA
TGAGGTCTATGGACTTCAGGCTCCGGTGCCCGTCAGTGGGCAG
AGCGCACATCGCCCACAGTCCCCGAGAAGTTGGGGGGAGGGG
TCGGCAATTGAACCGGTGCCTAGAGAAGGTGGCGCGGGGTAA
ACTGGGAAAGTGATGTCGTGTACTGGCTCCGCCTTTTTCCCGAG
GGTGGGGGAGAACCGTATATAAGTGCAGTAGTCGCCGTGAACG
TTCTTTTTCGCAACGGGTTTGCCGCCAGAACACAGGTAAGTGCC
GTGTGTGGTTCCCGCGGGCCTGGCCTCTTTACGGGTTATGGCCC
TTGCGTGCCTTGAATTACTTCCACTGGCTGCAGTACGTGATTCT
TGATCCCGAGCTTCGGGTTGGAAGTGGGTGGGAGAGTTCGAGG
CCTTGCGCTTAAGGAGCCCCTTCGCCTCGTGCTTGAGTTGAGGC
CTGGCCTGGGCGCTGGGGCCGCCGCGTGCGAATCTGGTGGCAC
CTTCGCGCCTGTCTCGCTGCTTTCGATAAGTCTCTAGCCATTTA
AAATTTTTGATGACCTGCTGCGACGCTTTTTTTCTGGCAAGATA
GTCTTGTAAATGCGGGCCAAGATCTGCACACTGGTATTTCGGTT
TTTGGGGCCGCGGGCGGCGACGGGGCCCGTGCGTCCCAGCGCA
CATGTTCGGCGAGGCGGGGCCTGCGAGCGCGGCCACCGAGAAT
CGGACGGGGGTAGTCTCAAGCTGGCCGGCCTGCTCTGGTGCCT
GGCCTCGCGCCGCCGTGTATCGCCCCGCCCTGGGCGGCAAGGC
TGGCCCGGTCGGCACCAGTTGCGTGAGCGGAAAGATGGCCGCT
TCCCGGCCCTGCTGCAGGGAGCTCAAAATGGAGGACGCGGCGC
TCGGGAGAGCGGGCGGGTGAGTCACCCACACAAAGGAAAAGG
GCCTTTCCGTCCTCAGCCGTCGCTTCATGTGACTCCACGGAGTA
CCGGGCGCCGTCCAGGCACCTCGATTAGTTCTCGAGCTTTTGGA
GTACGTCGTCTTTAGGTTGGGGGGAGGGGTTTTATGCGATGGA
GTTTCCCCACACTGAGTGGGTGGAGACTGAAGTTAGGCCAGCT
TGGCACTTGATGTAATTCTCCTTGGAATTTGCCCTTTTTGAGTTT
GGATCTTGGTTCATTCTCAAGCCTCAGACAGTGGTTCAAAGTTT
TTTTCTTCCATTTCAGGTGTCGTGACCACCATGGCGCTTCCGGT
GACAGCACTGCTCCTCCCCTTGGCGCTGTTGCTCCACGCAGCAA
GGCCGCAGGTGCAGCTGGTGCAGAGCGGAGCCGAGCTCAAGA
AGCCCGGAGCCTCCGTGAAGGTGAGCTGCAAGGCCAGCGGCA
ACACCCTGACCAACTACGTGATCCACTGGGTGAGACAAGCCCC
CGGCCAAAGGCTGGAGTGGATGGGCTACATCCTGCCCTACAAC
GACCTGACCAAGTACAGCCAGAAGTTCCAGGGCAGGGTGACC
ATCACCAGGGATAAGAGCGCCTCCACCGCCTATATGGAGCTGA
GCAGCCTGAGGAGCGAGGACACCGCTGTGTACTACTGTACAAG
GTGGGACTGGGACGGCTTCTTTGACCCCTGGGGCCAGGGCACA
ACAGTGACCGTCAGCAGCGGCGGCGGAGGCAGCGGCGGCGGC
GGCAGCGGCGGAGGCGGAAGCGAAATCGTGATGACCCAGAGC
CCCGCCACACTGAGCGTGAGCCCTGGCGAGAGGGCCAGCATCT
CCTGCAGGGCTAGCCAAAGCCTGGTGCACAGCAACGGCAACAC
CCACCTGCACTGGTACCAGCAGAGACCCGGACAGGCTCCCAGG
CTGCTGATCTACAGCGTGAGCAACAGGTTCTCCGAGGTGCCTG
CCAGGTTTAGCGGCAGCGGAAGCGGCACCGACTTTACCCTGAC
CATCAGCAGCGTGGAGTCCGAGGACTTCGCCGTGTATTACTGC
AGCCAGACCAGCCACATCCCTTACACCTTCGGCGGCGGCACCA
AGCTGGAGATCAAAAGTGCTGCTGCCTTTGTCCCGGTATTTCTC
CCAGCCAAACCGACCACGACTCCCGCCCCGCCCCTCCGACAC
CCGCTCCCACCATCGCCTCTCAACCTCTTAGTCTTCGCCCCGAG
GCATGCCGACCCGCCGCCGGGGGTGCTGTTCATACGAGGGGCT
TGGACTTCGCTTGTGATATTTACATTTGGGCTCCGTTGGCGGGT
ACGTGCGGCGTCCTTTTGTTGTCACTCGTTATTACTTTGTATTGT
AATCACAGGAATCGCAAACGGGGCAGAAAGAAACTCCTGTAT
ATATTCAAACAACCATTTATGAGACCAGTACAAACTACTCAAG
AGGAAGATGCTGTAGCTGCCGATTTCCAGAAGAAGAAGAAG
GAGGATGTGAACTGCGAGTGAAGTTTTCCCGAAGCGCAGACGC
TCCGGCATATCAGCAAGGACAGAATCAGCTGTATAACGAACTG
AATTTGGGACGCCGCGAGGAGTATGACGTGCTTGATAAACGCC
GGGGGAGAGACCCGGAAATGGGGGGTAAACCCCGAAGAAAGA
ATCCCCAAGAAGGACTCTACAATGAACTCCAGAAGGATAAGAT
GGCGGAGGCCTACTCAGAAATAGGTATGAAGGGCGAACGACG
ACGGGGAAAAGGTCACGATGGCCTCTACCAAGGGTTGAGTACG |

TABLE 35-continued

Donor Template Nucleotide Sequences-Left Homology Arm to Right Homology Arm

| SEQ ID NO: | Description | Sequence |
|---|---|---|
| | | GCAACCAAAGATACGTACGATGCACTGCATATGCAGGCCCTGC
CTCCCAGATAATAATAAAATCGCTATCCATCGAAGATGGATGT
GTGTTGGTTTTTTGTGTGTGGAGCAACAAATCTGACTTTGCATG
TGCAAACGCCTTCAACAACAGCATTATTCCAGAAGACACCTTC
TTCCCCAGCCCAGGTAAGGGCAGCTTTGGTGCCTTCGCAGGCT
GTTTCCTTGCTTCAGGAATGGCCAGGTTCTGCCCAGAGCTCTGG
TCAATGATGTCTAAAACTCCTCTGATTGGTGGTCTCGGCCTTAT
CCATTGCCACCAAAACCTCTTTTTACTAAGAAACAGTGAGCCT
TGTTCTGGCAGTCCAGAGAATGACACGGGAAAAAAGCAGATG
AAGAGAAGGTGGCAGGAGAGGGCACGTGGCCCAGCCTCAGTC
TCTCCAACTGAGTTCCTGCCTGCCTGCCTTTGCTCAGACTGTTT
GCCCCTTACTGCTCTTCTAGGCCTCATTCTAAGCCCCTTCTCCA
AGTTGCCTCTCCTTATTTCTCCCTGTCTGCCAAAAAATCTTTCCC
AGCTCACTAAGTCAGTCTCACGCAGTCACTCATTAACCCACCA
ATCACTGATTGTGCCGGCACATGAATGCACCAGGTGTTGAAGT
GGAGGAATTAAAAAGTCAGATGAGGGGTGTGCCCAGAGGAAG
CACCATTCTAGTTGGGGGAGCCCATCTGTCAGCTGGGAAAAGT
CCAAATAACTTCAGATTGGAATGTGTTTTAACTCAGGGTTGAG
AAAACAGCTACCTTCAGGACAAAAGTCAGGGAAGGGCTCTCTG
AAGAAATGCTACTTGAAGATACCAGCCCTACCAAGGGCAGGG
AGAGGACCCTATAGAGGCCTGGGACAGGAGCTCAATGAGAAA
GG |
| 1410 | LHA to RHA of CTX-167 | GAGATGTAAGGAGCTGCTGTGACTTGCTCAAGGCCTTATATCG
AGTAAACGGTAGTGCTGGGGCTTAGACGCAGGTGTTCTGATTT
ATAGTTCAAAACCTCTATCAATGAGAGCAATCTCCTGGTAA
TGTGATAGATTTCCCAACTTAATGCCAACATACCATAAACCTCC
CATTCTGCTAATGCCCAGCCTAAGTTGGGGAGACCACTCCAGA
TTCCAAGATGTACAGTTTGCTTTGCTGGGCCTTTTTCCCATGCC
TGCCTTTACTCTGCCAGAGTTATATTGCTGGGGTTTTGAAGAAG
ATCCTATTAAATAAAAGAATAAGCAGTATTATTAAGTAGCCCT
GCATTTCAGGTTTCCTTGAGTGGCAGGCCAGGCCTGGCCGTGA
ACGTTCACTGAAATCATGGCCTCTTGGCCAAGATTGATAGCTTG
TGCCTGTCCCTGAGTCCCAGTCCATCACGAGCAGCTGGTTTCTA
AGATGCTATTTCCCGTATAAAGCATGAGACCGTGACTTGCCAG
CCCCACAGAGCCCCGCCCTTGTCCATCACTGGCATCTGGACTCC
AGCCTGGGTTGGGGCAAAGAGGGAAATGAGATCATGTCCTAAC
CCTGATCCTCTTGTCCCACAGATATCCAGAACCCTGACCCTGCC
GTGTACCAGCTGAGAGACTCTAAATCCAGTGACAAGTCTGTCT
GCCTATTCACCGATTTTGATTCTCAAACAAATGTGTCACAAAGT
AAGGATTCTGATGTGTATATCACAGACAAAACTGTGCTAGACA
TGAGGTCTATGGACTTCAGGCTCCGGTGCCCGTCAGTGGGCAG
AGCGCACATCGCCCACAGTCCCCGAGAAGTTGGGGGGAGGGG
TCGGCAATTGAACCGGTGCCTAGAGAAGGTGGCGCGGGGTAA
ACTGGGAAAGTGATGTCGTGTACTGGCTCCGCCTTTTTCCCGAG
GGTGGGGGAGAACCGTATATAAGTGCAGTAGTCGCCGTGAACG
TTCTTTTTCGCAACGGGTTTGCCGCCAGAACACAGGTAAGTGCC
GTGTGTGGTTCCCGCGGGCCTGGCCTCTTTACGGGTTATGGCCC
TTGCGTGCCTTGAATTACTTCCACTGGCTGCAGTACGTGATTCT
TGATCCCGAGCTTCGGGTTGGAAGTGGGTGGGAGAGTTCGAGG
CCTTGCGCTTAAGGAGCCCCTTCGCCTCGTGCTTGAGTTGAGGC
CTGGCCTGGGCGCTGGGGCCGCCGCGTGCGAATCTGGTGGCAC
CTTCGCGCCTGTCTCGCTGCTTTCGATAAGTCTCTAGCCATTTA
AAATTTTTGATGACCTGCTGCGACGCTTTTTTTCTGGCAAGATA
GTCTTGTAAATGCGGGCCAAGATCTGCACACTGGTATTTCGGTT
TTTGGGGCGCGGGCGGCGACGGGGCCCGTGCGTCCCAGCGCA
CATGTTCGGCGAGGCGGGCCTGCGAGCGCGGCCACCGAGAAT
CGGACGGGGGTAGTCTCAAGCTGGCCGGCCTGCTCTGGTGCCT
GGCCTCGCGCCGCCGTGTATCGCCCCGCCCTGGGCGGCAAGGC
TGGCCCGGTCGGCACCAGTTGCGTGAGCGGAAAGATGGCCGCT
TCCCGGCCCTGCTGCAGGGAGCTCAAAATGGAGGACGCGGCGC
TCGGGAGAGCGGGCGGGTGAGTCACCCACACAAAGGAAAAGG
GCCTTTCCGTCCTCAGCCGTCGCTTCATGTGACTCCACGGAGTA
CCGGGCGCCGTCCAGGCACCTCGATTAGTTCTCGAGCTTTTGGA
GTACGTCGTCTTTAGGTTGGGGGAGGGGTTTTATGCGATGGA
GTTTCCCCACACTGAGTGGGTGGAGACTGAAGTTAGGCCAGCT
TGGCACTTGATGTAATTCTCCTTGGAATTTGCCCTTTTTGAGTTT
GGATCTTGGTTCATTCTCAAGCCTCAGACAGTGGTTCAAAGTTT
TTTTCTTCCATTTCAGGTGTCGTGACCACCATGGCGCTTCCGGT
GACAGCACTGCTCCTCCCCTTGGCGCTGTTGCTCCACGCAGCAA
GGCCGCAGGTGCAGCTGGTGCAGAGCGGCGCCGAGCTGAAGA
AACCTGGCGCCAGCGTCAAGGTGAGCTGCAAGGCTTCCGGAAA
CACCCTCACCAACTACGTGATCCACTGGGTGAGGCAGGCCCCC
GGACAGAGACTGGAGTGGATGGGCTACATTCTGCCCTACAACG
ACCTGACCAAGTACAGCCAGAAGTTCAGGGCAGGGTCACCAT |

TABLE 35-continued

Donor Template Nucleotide Sequences-Left Homology Arm to Right Homology Arm

| SEQ ID NO: | Description | Sequence |
|---|---|---|
|  |  | CACCAGGGACAAGAGCGCCAGCACCGCCTACATGGAGCTGAG
CAGCCTGAGGTCCGAGGACACAGCCGTGTACTACTGCACCAGG
TGGGACTGGGACGGATTCTTCGACCCTTGGGGCCAAGGCACCA
CAGTGACAGTGAGCTCCGGCGGAGGCGGCAGCGGCGGCGGAG
GAAGCGGCGGCGGCGGAAGCGACATCGTGATGACCCAGAGCC
CTCTGAGCCTGCCCGTGACACTGGGACAGCCTGCCACACTGTC
CTGCAGGAGCACCCAGAGCCTGGTGCATAGCAACGGCAACACC
CACCTGCACTGGTTCCAGCAGAGACCTGGCCAGAGCCCCCTGA
GACTGATCTACAGCGTGAGCAACAGGGACAGCGGCGTGCCCG
ATAGATTTAGCGGCAGCGGCAGCGGCACCGACTTTACCCTGAA
AATCTCCAGGGTGGAGGCCGAGGATGTGGGCGTGTATTACTGC
TCCCAGACAAGCCACATTCCCTATACATTCGGCGGCGGCACCA
AGCTGGAGATCAAGAGTGCTGCTGCCTTTGTCCCGGTATTTCTC
CCAGCCAAACCGACCACGACTCCCGCCCCGCGCCCTCCGACAC
CCGCTCCCACCATCGCCTCTCAACCTCTTAGTCTTCGCCCCGAG
GCATGCCGACCCGCCGCCGGGGGTGCTGTTCATACGAGGGGCT
TGGACTTCGCTTGTGATATTTACATTTGGGCTCCGTTGGCGGGT
ACGTGCGGCGTCCTTTTGTTGTCACTCGTTATTACTTTGTATTGT
AATCACAGGAATCGCTCAAAGCGGAGTAGGTTGTTGCATTCCG
ATTACATGAATATGACTCCTCGCCGGCCTGGGCCGACAAGAAA
ACATTACCAACCCTATGCCCCCCCACGAGACTTCGCTGCGTAC
AGGTCCCGAGTGAAGTTTTCCCGAAGCGCAGACGCTCCGGCAT
ATCAGCAAGGACAGAATCAGCTGTATAACGAACTGAATTTGGG
ACGCCGCGAGGAGTATGACGTGCTTGATAAACGCCGGGGGAG
AGACCCGGAAATGGGGGGTAAACCCCGAAGAAAGAATCCCCA
AGAAGGACTCTACAATGAACTCCAGAAGGATAAGATGGCGGA
GGCCTACTCAGAAATAGGTATGAAGGGCGAACGACGACGGGG
AAAAGGTCACGATGGCCTCTACCAAGGGTTGAGTACGGCAACC
AAAGATACGTACGATGCACTGCATATGCAGGCCCTGCCTCCCA
GATAATAATAAAATCGCTATCCATCGAAGATGGATGTGTGTTG
GTTTTTTGTGTGTGGAGCAACAAATCTGACTTTGCATGTGCAAA
CGCCTTCAACAACAGCATTATTCCAGAAGACACCTTCTTCCCCA
GCCCAGGTAAGGGCAGCTTTGGTGCCTTCGCAGGCTGTTTCCTT
GCTTCAGGAATGGCCAGGTTCTGCCCAGAGCTCTGGTCAATGA
TGTCTAAAACTCCTCTGATTGGTGGTCTCGGCCTTATCCATTGC
CACCAAAACCCTCTTTTTACTAAGAAACAGTGAGCCTTGTTCTG
GCAGTCCAGAGAATGACACGGGAAAAAAGCAGATGAAGAGAA
GGTGGCAGGAGAGGGCACGTGGCCCAGCCTCAGTCTCTCCAAC
TGAGTTCCTGCCTGCCTGCCTTTGCTCAGACTGTTTGCCCCTTA
CTGCTCTTCTAGGCCTCATTCTAAGCCCCTTCTCCAAGTTGCCT
CTCCTTATTTCTCCCTGTCTGCCAAAAAATCTTTCCCAGCTCACT
AAGTCAGTCTCACGCAGTCACTCATTAACCCACCAATCACTGA
TTGTGCCGGCACATGAATGCACCAGGTGTTGAAGTGGAGGAAT
TAAAAAGTCAGATGAGGGGTGTGCCCAGAGGAAGCACCATTCT
AGTTGGGGGAGCCCATCTGTCAGCTGGGAAAAGTCCAAATAAC
TTCAGATTGGAATGTGTTTTAACTCAGGGTTGAGAAAACAGCT
ACCTTCAGGACAAAAGTCAGGGAAGGGCTCTCTGAAGAAATGC
TACTTGAAGATACCAGCCCTACCAAGGGCAGGGAGAGGACCCT
ATAGAGGCTGGGACAGGAGCTCAATGAGAAAGG |
| 1411 | LHA to RHA of CTX-168 | GAGATGTAAGGAGCTGCTGTGACTTGCTCAAGGCCTTATATCG
AGTAAACGGTAGTGCTGGGGCTTAGACGCAGGTGTTCTGATTT
ATAGTTCAAAACCTCTATCAATGAGAGAGCAATCTCCTGGTAA
TGTGATAGATTTCCCAACTTAATGCCAACATACCATAAACCTCC
CATTCTGCTAATGCCCAGCCTAAGTTGGGGAGACCACTCCAGA
TTCCAAGATGTACAGTTTGCTTTGCTGGGCCTTTTTCCCATGCC
TGCCTTTACTCTGCCAGAGTTATATTGCTGGGGTTTTGAAGAAG
ATCCTATTAAATAAAAGAATAAGCAGTATTATTAAGTAGCCCT
GCATTTCAGGTTTCCTTGAGTGGCAGGCCAGGCCTGGCCGTGA
ACGTTCACTGAAATCATGGCCTCTTGGCCAAGATTGATAGCTTG
TGCCTGTCCCTGAGTCCCAGTCCATCACGAGCAGCTGGTTTCTA
AGATGCTATTTCCCGTATAAAGCATGAGACCGTGACTTGCCAG
CCCCACAGAGCCCCGCCCTTGTCCATCACTGGCATCTGGACTCC
AGCCTGGGTTGGGCAAAGAGGGAAATGAGATCATGTCCTAAC
CCTGATCCTCTTGTCCCACAGATATCCAGAACCCTGACCCTGCC
GTGTACCAGCTGAGAGACTCTAAATCCAGTGACAAGTCTGTCT
GCCTATTCACCGATTTTGATTCTCAAACAAATGTGTCACAAAGT
AAGGATTCTGATGTGTATATCACAGACAAAACTGTGCTAGACA
TGAGGTCTATGGACTTCAGGCTCCGGTGCCCGTCAGTGGGCAG
AGCGCACATCGCCCACAGTCCCCGAGAAGTTGGGGGGAGGGG
TCGGCAATTGAACCGGTGCCTAGAGAAGGTGGCGCGGGGTAA
ACTGGGAAAGTGATGTCGTGTACTGGCTCCGCCTTTTTCCCGAG
GGTGGGGGAGAACCGTATATAAGTGCAGTAGTCGCCGTGAACG
TTCTTTTTCGCAACGGGTTTGCCGCCAGAACACAGGTAAGTGCC
GTGTGTGGTTCCCGCGGGCCTGGCCTCTTTACGGGTTATGGCCC |

TABLE 35-continued

Donor Template Nucleotide Sequences-Left Homology Arm to Right Homology Arm

| SEQ ID NO: | Description | Sequence |
|---|---|---|
| | | TTGCGTGCCTTGAATTACTTCCACTGGCTGCAGTACGTGATTCT
TGATCCCGAGCTTCGGGTTGGAAGTGGGTGGGAGAGTTCGAGG
CCTTGCGCTTAAGGAGCCCCTTCGCCTCGTGCTTGAGTTGAGGC
CTGGCCTGGGCGCTGGGGCCGCCGCGTGCGAATCTGGTGGCAC
CTTCGCGCCTGTCTCGCTGCTTTCGATAAGTCTCTAGCCATTTA
AAATTTTTGATGACCTGCTGCGACGCTTTTTTTCTGGCAAGATA
GTCTTGTAAATGCGGGCCAAGATCTGCACACTGGTATTTCGGTT
TTTGGGGCCGCGGGCGGCGACGGGGCCCGTGCGTCCCAGCGCA
CATGTTCGGCGAGGCGGGGCCTGCGAGCGCGGCCACCGAGAAT
CGGACGGGGGTAGTCTCAAGCTGGCCGGCCTGCTCTGGTGCCT
GGCCTCGCGCCGCCGTGTATCGCCCCGCCCTGGGCGGCAAGGC
TGGCCCGGTCGGCACCAGTTGCGTGAGCGGAAAGATGGCCGCT
TCCCGGCCCTGCTGCAGGGAGCTCAAAATGGAGGACGCGGCGC
TCGGGAGAGCGGGCGGGTGAGTCACCCACACAAAGGAAAAGG
GCCTTTCCGTCCTCAGCCGTCGCTTCATGTGACTCCACGGAGTA
CCGGGCGCCGTCCAGGCACCTCGATTAGTTCTCGAGCTTTTGGA
GTACGTCGTCTTTAGGTTGGGGGGAGGGGTTTTATGCGATGGA
GTTTCCCCACACTGAGTGGGTGGAGACTGAAGTTAGGCCAGCT
TGGCACTTGATGTAATTCTCCTTGGAATTTGCCCTTTTTGAGTTT
GGATCTTGGTTCATTCTCAAGCCTCAGACAGTGGTTCAAAGTTT
TTTTCTTCCATTTCAGGTGTCGTGACCACCATGGCGCTTCCGGT
GACAGCACTGCTCCTCCCCTTGGCGCTGTTGCTCCACGCAGCAA
GGCCGGAAATCGTGATGACCCAGAGCCCTGCCACACTGAGCGT
GAGCCCTGGCGAGAGAGCCAGCATCAGCTGCAGGGCCTCCCAG
AGCCTGGTGCACTCCAACGGCAATACCCACCTGCACTGGTATC
AGCAGAGACCCGGCCAGGCCCTAGGCTGCTGATCTACTCCGT
GAGCAACAGGTTCTCCGAGGTGCCCGCCAGATTCAGCGGATCC
GGCAGCGGCACCGACTTCACCCTCACCATCTCCAGCGTGGAGA
GCGAGGACTTCGCCGTCTACTACTGCAGCCAGACAAGCCACAT
CCCCTACACCTTCGGCGGCGGCACCAAGCTGGAGATCAAGGGC
GGCGGCGGCAGCGGCGGCGGAGGCAGCGGAGGCGGCGGATCC
CAGGTGCAACTGGTGCAGAGCGGAGCCGAGCTGAAGAAGCCC
GGAGCCAGCGTGAAGGTCAGCTGCAAGGCCAGCGGCAACACC
CTGACAAACTACGTGATCCACTGGGTGAGGCAGGCCCCTGGCC
AAAGGCTCGAGTGGATGGGCTACATCCTCCCCTACAACGACCT
GACCAAGTACTCCCAGAAGTTCCAGGGCAGGGTGACCATCACC
AGGGATAAGAGCGCCAGCACCGCCTACATGGAACTCAGCAGC
CTGAGGAGCGAGGACACCGCCGTGTACTACTGCACCAGGTGGG
ACTGGGATGGCTTCTTCGACCCTTGGGGCCAGGGCACCACCGT
GACAGTGAGCTCCAGTGCTGCTGCCTTTGTCCCGGTATTTCTCC
CAGCCAAACCGACCACGACTCCCGCCCCGCGCCCTCCGACACC
CGCTCCCACCATCGCCTCTCAACCTCTTAGTCTTCGCCCCGAGG
CATGCCGACCCGCCGCCGGGGGTGCTGTTCATACGAGGGGCTT
GGACTTCGCTTGTGATATTTACATTTGGGCTCCGTTGGCGGGTA
CGTGCGGCGTCCTTTTGTTGTCACTCGTTATTACTTTGTATTGTA
ATCACAGGAATCGCTCAAAGCGGAGTAGGTTGTTGCATTCCGA
TTACATGAATATGACTCCTCGCCGGCCTGGGCCGACAAGAAAA
CATTACCAACCCTATGCCCCCCCACGAGACTTCGCTGCGTACA
GGTCCCGAGTGAAGTTTTCCCGAAGCGCAGACGCTCCGGCATA
TCAGCAAGGACAGAATCAGCTGTATAACGAACTGAATTTGGGA
CGCCGCGAGGAGTATGACGTGCTTGATAAACGCCGGGGGAGA
GACCCGGAAATGGGGGGTAAACCCCGAAGAAAGAATCCCCAA
GAAGGACTCTACAATGAACTCCAGAAGGATAAGATGGCGGAG
GCCTACTCAGAAATAGGTATGAAGGGCGAACGACGACGGGGA
AAAGGTCACGATGGCCTCTACCAAGGGTTGAGTACGGCAACCA
AAGATACGTACGATGCACTGCATATGCAGGCCCTGCCTCCCAG
ATAATAATAAAATCGCTATCCATCGAAGATGGATGTGTGTTGG
TTTTTTGTGTGTGGAGCAACAAATCTGACTTTGCATGTGCAAAC
GCCTTCAACAACAGCATTATTCCAGAAGACACCTTCTTCCCCAG
CCCAGGTAAGGGCAGCTTTGGTGCCTTCGCAGGCTGTTTCCTTG
CTTCAGGAATGGCCAGGTTCTGCCCAGAGCTCTGGTCAATGAT
GTCTAAAACTCCTCTGATTGGTGGTCTCGGCCTTATCCATTGCC
ACCAAAACCCTCTTTTTACTAAGAAACAGTGAGCCTTGTTCTGG
CAGTCCAGAGAATGACACGGGAAAAAAGCAGATGAAGAGAAG
GTGGCAGGAGAGGGCACGTGGCCCAGCCTCAGTCTCTCCAACT
GAGTTCCTGCCTGCCTGCCTTTGCTCAGACTGTTTGCCCCTTAC
TGCTCTTCTAGGCCTCATTCTAAGCCCCTTCTCCAAGTTGCCTCT
CCTTATTTCTCCCTGTCTGCCAAAAAATCTTTCCCAGCTCACTA
AGTCAGTCTCACGCAGTCACTCATTAACCCACCAATCACTGATT
GTGCCGGCACATGAATGCACCAGGTGTTGAAGTGGAGGAATTA
AAAAGTCAGATGAGGGGTGTGCCCAGAGGAAGCACCATTCTA
GTTGGGGGAGCCCATCTGTCAGCTGGGAAAAGTCCAAATAACT
TCAGATTGGAATGTGTTTTAACTCAGGGTTGAGAAAACAGCTA
CCTTCAGGACAAAAGTCAGGGAAGGGCTCTCTGAAGAAATGCT |

TABLE 35-continued

Donor Template Nucleotide Sequences-Left Homology Arm to Right Homology Arm

| SEQ ID NO: | Description | Sequence |
|---|---|---|
| | | ACTTGAAGATACCAGCCCTACCAAGGGCAGGGAGAGGACCCT<br>ATAGAGGCCTGGGACAGGAGCTCAATGAGAAAGG |
| 1412 | LHA to RHA of CTX-169 | GAGATGTAAGGAGCTGCTGTGACTTGCTCAAGGCCTTATATCG<br>AGTAAACGGTAGTGCTGGGGCTTAGACGCAGGTGTTCTGATTT<br>ATAGTTCAAAACCTCTATCAATGAGAGAGCAATCTCCTGGTAA<br>TGTGATAGATTTCCCAACTTAATGCCAACATACCATAAACCTCC<br>CATTCTGCTAATGCCCAGCCTAAGTTGGGGAGACCACTCCAGA<br>TTCCAAGATGTACAGTTTGCTTTGCTGGGCCTTTTTCCCATGCC<br>TGCCTTTACTCTGCCAGAGTTATATTGCTGGGGTTTTGAAGAAG<br>ATCCTATTAAATAAAAGAATAAGCAGTATTATTAAGTAGCCCT<br>GCATTTCAGGTTTCCTTGAGTGGCAGGCCAGGCCTGGCCGTGA<br>ACGTTCACTGAAATCATGGCCTCTTGGCCAAGATTGATAGCTTG<br>TGCCTGTCCCTGAGTCCCAGTCCATCACGAGCAGCTGGTTTCTA<br>AGATGCTATTTCCCGTATAAAGCATGAGACCGTGACTTGCCAG<br>CCCCACAGAGCCCCGCCCTTGTCCATCACTGGCATCTGGACTCC<br>AGCCTGGGTTGGGCAAAGAGGGAAATGAGATCATGTCCTAAC<br>CCTGATCCTCTTGTCCCACAGATATCCAGAACCCTGACCCTGCC<br>GTGTACCAGCTGAGAGACTCTAAATCAGTGACAAGTCTGTCT<br>GCCTATTCACCGATTTTGATTCTCAAACAAATGTGTCACAAAGT<br>AAGGATTCTGATGTGTATATCACAGACAAAACTGTGCTAGACA<br>TGAGGTCTATGGACTTCAGGCTCCGGTGCCCGTCAGTGGGCAG<br>AGCGCACATCGCCCACAGTCCCCGAGAAGTTGGGGGGAGGGG<br>TCGGCAATTGAACCGGTGCCTAGAGAAGGTGGCGCGGGGTAA<br>ACTGGGAAAGTGATGTCGTGTACTGGCTCCGCCTTTTTCCCGAG<br>GGTGGGGGAGAACCGTATATAAGTGCAGTAGTCGCCGTGAACG<br>TTCTTTTTCGCAACGGGTTTGCCGCCAGAACACAGGTAAGTGCC<br>GTGTGTGGTTCCCGCGGGCCTGGCCTCTTTACGGGTTATGGCCC<br>TTGCGTGCCTTGAATTACTTCCACTGGCTGCAGTACGTGATTCT<br>TGATCCCGAGCTTCGGGTTGGAAGTGGGTGGGAGAGTTCGAGG<br>CCTTGCGCTTAAGGAGCCCCTTCGCCTCGTGCTTGAGTTGAGGC<br>CTGGCCTGGGCGCTGGGGCCGCCGCGTGCGAATCTGGTGGCAC<br>CTTCGCGCCTGTCTCGCTGCTTTCGATAAGTCTCTAGCCATTTA<br>AAATTTTTGATGACCTGCTGCGACGCTTTTTTTCTGGCAAGATA<br>GTCTTGTAAATGCGGGCCAAGATCTGCACACTGGTATTTCGGTT<br>TTTGGGGCCGCGGGCGGCGACGGGGCCCGTGCGTCCCAGCGCA<br>CATGTTCGGCGAGGCGGGGCCTGCGAGCGCGGCCACCGAGAAT<br>CGGACGGGGGTAGTCTCAAGCTGGCCGGCCTGCTCTGGTGCCT<br>GGCCTCGCGCCGCCGTGTATCGCCCCGCCCTGGGCGGCAAGGC<br>TGGCCCGGTCGGCACCAGTTGCGTGAGCGGAAAGATGGCCGCT<br>TCCCGGCCCTGCTGCAGGGAGCTCAAAATGGAGGACGCGGCGC<br>TCGGGAGAGCGGGCGGGTGAGTCACCCACACAAAGGAAAAGG<br>GCCTTTCCGTCCTCAGCCGTCGCTTCATGTGACTCCACGGAGTA<br>CCGGGCGCCGTCCAGGCACCTCGATTAGTTCTCGAGCTTTTGGA<br>GTACGTCGTCTTTAGGTTGGGGGGAGGGGTTTTATGCGATGGA<br>GTTTCCCCACACTGAGTGGGTGGAGACTGAAGTTAGGCCAGCT<br>TGGCACTTGATGTAATTCTCCTTGGAATTTGCCCTTTTTGAGTTT<br>GGATCTTGGTTCATTCTCAAGCCTCAGACAGTGGTTCAAAGTTT<br>TTTTCTTCCATTTCAGGTGTCGTGACCACCATGGCGCTTCCGGT<br>GACAGCACTGCTCCTCCCCTTGGCGCTGTTGCTCCACGCAGCAA<br>GGCCGGACATCGTGATGACACAATCCCCCCTCAGCCTGCCTGT<br>GACACTGGGCCAGCCTGCCACCCTGAGCTGCAGGAGCACCCAG<br>TCCCTGGTGCACTCCAACGGCAACACCCACCTGCTCACTGGTTCC<br>AGCAGAGGCCTGGACAGAGCCCCCTGAGGCTGATCTACAGCGT<br>GAGCAACAGGGACTCCGGCGTGCCCGATAGATTCAGCGGCAGC<br>GGCTCCGGCACCGATTTCACCCTGAAGATCTCCAGAGTGGAAG<br>CCGAGGACGTGGGCGTCTACTACTGCAGCCAGACCAGCCATAT<br>CCCCTACACCTTCGGCGGCGGCACCAAGCTGGAGATCAAGGGA<br>GGCGGCGGAAGCGGCGGAGGCGGATCCGGAGGCGGAGGCTCC<br>CAAGTGCAGCTGGTGCAGAGCGGCGCTGAGCTGAAGAAGCCC<br>GGAGCCAGCGTGAAGGTGAGCTGCAAGGCCAGCGGAAACACC<br>CTGACCAACTACGTGATCCACTGGGTGAGACAGGCCCCCGGAC<br>AGAGACTCGAGTGGATGGGCTACATCCTGCCCTACAACGACCT<br>GACCAAGTACAGCCAGAAGTTCCAGGGCAGGGTGACAATCAC<br>CAGGGACAAGAGCGCCAGCACCGCCTACATGGAGCTGAGCAG<br>CCTGAGATCCGAGGACACCGCCGTGTACTACTGCACCAGGTGG<br>GACTGGGACGGCTTCTTTGACCCCTGGGGCCAGGGAACCACAG<br>TGACCGTGTCCTCCAGTGCTGCTGCCTTTGTCCCGGTATTTCTC<br>CCAGCCAAACCGACCACGACTCCCGCCCCGCGCCCTCCGACAC<br>CCGCTCCCACCATCGCCTCTCAACCTCTTAGTCTTCGCCCCGAG<br>GCATGCCGACCCGCCGCCGGGGGTGCTGTTCATACGAGGGGCT<br>TGGACTTCGCTTGTGATATTTACATTTGGGCTCCGTTGGCGGGT<br>ACGTGCGGCGTCCTTTTGTTGTCACTCGTTATTACTTTGTATTGT<br>AATCACAGGAATCGCTCAAAGCGGAGTAGGTTGTTGCATTCCG<br>ATTACATGAATATGACTCCTCGCCGGCCTGGGCCGACAAGAAA |

TABLE 35-continued

Donor Template Nucleotide Sequences-Left Homology Arm to Right Homology Arm

| SEQ ID NO: | Description | Sequence |
|---|---|---|
| | | ACATTACCAACCCTATGCCCCCCACGAGACTTCGCTGCGTAC<br>AGGTCCCGAGTGAAGTTTTCCCGAAGCGCAGACGCTCCGGCAT<br>ATCAGCAAGGACAGAATCAGCTGTATAACGAACTGAATTTGGG<br>ACGCCGCGAGGAGTATGACGTGCTTGATAAACGCCGGGGGAG<br>AGACCCGGAAATGGGGGGTAAACCCCGAAGAAAGAATCCCCA<br>AGAAGGACTCTACAATGAACTCCAGAAGGATAAGATGGCGGA<br>GGCCTACTCAGAAATAGGTATGAAGGGCGAACGACGACGGGG<br>AAAAGGTCACGATGGCCTCTACCAAGGGTTGAGTACGGCAACC<br>AAAGATACGTACGATGCACTGCATATGCAGGCCCTGCCTCCCA<br>GATAATAATAAAATCGCTATCCATCGAAGATGGATGTGTGTTG<br>GTTTTTTGTGTGTGGAGCAACAAATCTGACTTTGCATGTGCAAA<br>CGCCTTCAACAACAGCATTATTCCAGAAGACACCTTCTTCCCCA<br>GCCCAGGTAAGGGCAGCTTTGGTGCCTTCGCAGGCTGTTTCCTT<br>GCTTCAGGAATGGCCAGGTTCTGCCCAGAGCTCTGGTCAATGA<br>TGTCTAAAACTCCTCTGATTGGTGGTCTCGGCCTTATCCATTGC<br>CACCAAAACCCTCTTTTTACTAAGAAACAGTGAGCCTTGTTCTG<br>GCAGTCCAGAGAATGACACGGGAAAAAAGCAGATGAAGAGAA<br>GGTGGCAGGAGAGGGCACGTGGCCCAGCCTCAGTCTCTCCAAC<br>TGAGTTCCTGCCTGCCTGCCTTTGCTCAGACTGTTTGCCCCTTA<br>CTGCTCTTCTAGGCCTCATTCTAAGCCCCTTCTCCAAGTTGCCT<br>CTCCTTATTTCTCCCTGTCTGCCAAAAAATCTTTCCCAGCTCACT<br>AAGTCAGTCTCACGCAGTCACTCATTAACCCACCAATCACTGA<br>TTGTGCCGGCACATGAATGCACCAGGTGTTGAAGTGGAGGAAT<br>TAAAAAGTCAGATGAGGGGTGTGCCCAGAGGAAGCACCATTCT<br>AGTTGGGGGAGCCCATCTGTCAGCTGGGAAAAGTCCAAATAAC<br>TTCAGATTGGAATGTGTTTTAACTCAGGGTTGAGAAAACAGCT<br>ACCTTCAGGACAAAAGTCAGGGAAGGGCTCTCTGAAGAAATGC<br>TACTTGAAGATACCAGCCCTACCAAGGGCAGGGAGAGGACCCT<br>ATAGAGGCCTGGGACAGGAGCTCAATGAGAAAGG |
| 1413 | LHA to RHA of CTX-170 | GAGATGTAAGGAGCTGCTGTGACTTGCTCAAGGCCTTATATCG<br>AGTAAACGGTAGTGCTGGGGCTTAGACGCAGGTGTTCTGATTT<br>ATAGTTCAAAACCTCTATCAATGAGAGAGCAATCTCCTGGTAA<br>TGTGATAGATTTCCCAACTTAATGCCAACATACCATAAACCTCC<br>CATTCTGCTAATGCCCAGCCTAAGTTGGGGAGACCACTCCAGA<br>TTCCAAGATGTACAGTTTGCTTTGCTGGGCCTTTTTCCCATGCC<br>TGCCTTTACTCTGCCAGAGTTATATTGCTGGGGTTTTGAAGAAG<br>ATCCTATTAAATAAAAGAATAAGCAGTATTATTAAGTAGCCCT<br>GCATTTCAGGTTTCCTTGAGTGGCAGGCCAGGCCTGGCCGTGA<br>ACGTTCACTGAAATCATGGCCTCTTGGCCAAGATTGATAGCTTG<br>TGCCTGTCCCTGAGTCCCAGTCCATCACGAGCAGCTGGTTTCTA<br>AGATGCTATTTCCCGTATAAAGCATGAGACCGTGACTTGCCAG<br>CCCCACAGAGCCCCGCCCTTGTCCATCACTGGCATCTGGACTCC<br>AGCCTGGGTTGGGGCAAAGAGGGAAATGAGATCATGTCCTAAC<br>CCTGATCCTCTTGTCCCACAGATATCCAGAACCCTGACCCTGCC<br>GTGTACCAGCTGAGAGACTCTAAATCCAGTGACAAGTCTGTCT<br>GCCTATTCACCGATTTTGATTCTCAAACAAATGTGTCACAAAGT<br>AAGGATTCTGATGTGTATATCACAGACAAAACTGTGCTAGACA<br>TGAGGTCTATGGACTTCAGGCTCCGGTGCCCGTCAGTGGGCAG<br>AGCGCACATCGCCCACAGTCCCCGAGAAGTTGGGGGGAGGGG<br>TCGGCAATTGAACCGGTGCCTAGAGAAGGTGGCGCGGGGTAA<br>ACTGGGAAAGTGATGTCGTGTACTGGCTCCGCCTTTTTCCCGAG<br>GGTGGGGGAGAACCGTATATAAGTGCAGTAGTCGCCGTGAACG<br>TTCTTTTTCGCAACGGGTTTGCCGCCAGAACACAGGTAAGTGCC<br>GTGTGTGGTTCCCGCGGGCCTGGCCTCTTTACGGGTTATGGCCC<br>TTGCGTGCCTTGAATTACTTCCACTGGCTGCAGTACGTGATTCT<br>TGATCCCGAGCTTCGGGTTGGAAGTGGGTGGGAGAGTTCGAGG<br>CCTTGCGCTTAAGGAGCCCCTTCGCCTCGTGCTTGAGTTGAGGC<br>CTGGCCTGGGCGCTGGGGCCGCCGCGTGCGAATCTGGTGGCAC<br>CTTCGCGCCTGTCTCGCTGCTTTCGATAAGTCTCTAGCCATTTA<br>AAATTTTTGATGACCTGCTGCGACGCTTTTTTTCTGGCAAGATA<br>GTCTTGTAAATGCGGGCCAAGATCTGCACACTGGTATTTCGGTT<br>TTTGGGGCCGCGGGCGGCGACGGGGCCCGTGCGTCCCAGCGCA<br>CATGTTCGGCGAGGCGGGCCTGCGAGCGCGGCCACCGAGAAT<br>CGGACGGGGGTAGTCTCAAGCTGGCCGGCCTGCTCTGGTGCCT<br>GGCCTCGCGCCGCCGTGTATCGCCCCGCCCTGGGCGGCAAGGC<br>TGGCCCGGTCGGCACCAGTTGCGTGAGCGGAAAGATGGCCGCT<br>TCCCGGCCCTGCTGCAGGGAGCTCAAAATGGAGGACGCGGCGC<br>TCGGGAGAGCGGGCGGGTGAGTCACCCACACAAAGGAAAAGG<br>GCCTTTCCGTCCTCAGCCGTCGCTTCATGTGACTCACGGAGTA<br>CCGGGCGCCGTCCAGGCACCTCGATTAGTTCTCGAGCTTTTGGA<br>GTACGTCGTCTTTAGGTTGGGGGGAGGGGTTTTATGCGATGGA<br>GTTTCCCCACACTGAGTGGGTGGAGACTGAAGTTAGGCCAGCT<br>TGGCACTTGATGTAATTCTCCTTGGAATTTGCCCTTTTTGAGTTT<br>GGATCTTGGTTCATTCTCAAGCCTCAGACAGTGGTTCAAAGTTT |

TABLE 35-continued

Donor Template Nucleotide Sequences-Left Homology Arm to Right Homology Arm

| SEQ ID NO: | Description | Sequence |
|---|---|---|
| | | TTTTCTTCCATTTCAGGTGTCGTGACCACCATGGCGCTTCCGGT
GACAGCACTGCTCCTCCCCTTGGCGCTGTTGCTCCACGCAGCAA
GGCCGGAGGTGCAGCTGCAGCAGAGCGGCCCTGAGCTGGTGA
AGCCCGGCGCCAGCGTGAAGATCAGCTGCAAGACCTCCGGCTA
TACCTTTACCGAGTACACCATCAACTGGGTGAAGCAGAGCCAC
GGCAAGAGCCTGGAGTGGATCGGCGATATCTACCCCGACAACT
ACAACATCAGGTACAACCAGAAGTTCAAGGGCAAGGCCACCCT
GACCGTGGACAAGTCCAGCAGCACCGCCTACATGGAGCTGAGG
AGCCTGTCCAGCGAGGACTCCGCCATCTACTACTGCGCCAACC
ACGACTTTTTCGTCTTCTGGGGACAGGGCACCCTGGTGACAGT
GTCCGCTGGCGGCGGCGGCAGCGGCGGCGGCGGCTCCGGAGG
CGGCGGCAGCGACATCCAGATGACACAGGCCACAAGCTCCCTG
TCCGCCAGCCTGGGCGATAGGGTGACCATCAATTGCAGGACCT
CCCAGGACATCAGCAACCACCTGAACTGGTACCAGCAGAAACC
CGACGGCACCGTGAAGCTGCTCATCTACTACACCAGCAGGCTG
CAGTCCGGCGTCCCTAGCAGATTCAGCGGATCCGGCAGCGGCA
CCGACTATAGCCTGACCATCAGCAACCTCGAGCAGGAGGACAT
CGGCACCTACTTCTGCCATCAGGGCAACACCCTGCCCCCTACCT
TTGGCGGCGGCACAAAGCTGGAGATTAAGAGTGCTGCTGCCTT
TGTCCCGGTATTTCTCCCAGCCAAACCGACCACGACTCCCGCCC
CGCGCCCTCCGACACCCGCTCCCACCATCGCCTCTCAACCTCTT
AGTCTTCGCCCCGAGGCATGCCGACCCGCCGCCGGGGGTGCTG
TTCATACGAGGGGCTTGGACTTCGCTTGTGATATTTACATTTGG
GCTCCGTTGGCGGGTACGTGCGGCGTCCTTTTGTTGTCACTCGT
TATTACTTTGTATTGTAATCACAGGAATCGCTCAAAGCGGAGT
AGGTTGTTGCATTCCGATTACATGAATATGACTCCTCGCCGGCC
TGGGCCGACAAGAAAACATTACCAACCCTATGCCCCCCCACGA
GACTTCGCTGCGTACAGGTCCCGAGTGAAGTTTTCCCGAAGCG
CAGACGCTCCGGCATATCAGCAAGGACAGAATCAGCTGTATAA
CGAACTGAATTTGGGACGCCGCGAGGAGTATGACGTGCTTGAT
AAACGCCGGGGAGAGACCCGGAAATGGGGGGTAAACCCCGA
AGAAAGAATCCCCAAGAAGGACTCTACAATGAACTCCAGAAG
GATAAGATGGCGGAGGCCTACTCAGAAATAGGTATGAAGGGC
GAACGACGACGGGGAAAAGGTCACGATGGCCTCTACCAAGGG
TTGAGTACGGCAACCAAAGATACGTACGATGCACTGCATATGC
AGGCCCTGCCTCCCAGATAATAATAAAATCGCTATCCATCGAA
GATGGATGTGTGTTGGTTTTTTGTGTGTGGAGCAACAAATCTGA
CTTTGCATGTGCAAACGCCTTCAACAACAGCATTATTCCAGAA
GACACCTTCTTCCCCAGCCCAGGTAAGGGCAGCTTTGGTGCCTT
CGCAGGCTGTTTCCTTGCTTCAGGAATGGCCAGGTTCTGCCCAG
AGCTCTGGTCAATGATGTCTAAAACTCCTCTGATTGGTGGTCTC
GGCCTTATCCATTGCCACCAAAACCCTCTTTTTACTAAGAAACA
GTGAGCCTTGTTCTGGCAGTCCAGAGAATGACACGGGAAAAAA
GCAGATGAAGAGAAGGTGGCAGGAGAGGGCACGTGGCCCAGC
CTCAGTCTCTCCAACTGAGTTCCTGCCTGCCTGCCTTTGCTCAG
ACTGTTTGCCCCTTACTGCTCTTCTAGGCCTCATTCTAAGCCCCT
TCTCCAAGTTGCCTCTCCTTATTTCTCCCTGTCTGCCAAAAAAT
CTTTCCCAGCTCACTAAGTCAGTCTCACGCAGTCACTCATTAAC
CCACCAATCACTGATTGTGCCGGCACATGAATGCACCAGGTGT
TGAAGTGGAGGAATTAAAAAGTCAGATGAGGGGTGTGCCCAG
AGGAAGCACCATTCTAGTTGGGGGAGCCCATCTGTCAGCTGGG
AAAAGTCCAAATAACTTCAGATTGGAATGTGTTTTAACTCAGG
GTTGAGAAAACAGCTACCTTCAGGACAAAAGTCAGGGAAGGG
CTCTCTGAAGAAATGCTACTTGAAGATACCAGCCCTACCAAGG
GCAGGGAGAGGACCCTATAGAGGCCTGGGACAGGAGCTCAAT
GAGAAAGG |
| 1414 | LHA to RHA of CTX-171 | GAGATGTAAGGAGCTGCTGTGACTTGCTCAAGGCCTTATATCG
AGTAAACGGTAGTGCTGGGGCTTAGACGCAGGTGTTCTGATTT
ATAGTTCAAAACCTCTATCAATGAGAGAGCAATCTCCTGGTAA
TGTGATAGATTTCCCAACTTAATGCCAACATACCATAAACCTCC
CATTCTGCTAATGCCCAGCCTAAGTTGGGGAGACCACTCCAGA
TTCCAAGATGTACAGTTTGCTTTGCTGGGCCTTTTTCCCATGCC
TGCCTTTACTCTGCCAGAGTTATATTGCTGGGGTTTTGAAGAAG
ATCCTATTAAATAAAAGAATAAGCAGTATTATTAAGTAGCCCT
GCATTTCAGGTTTCCTTGAGTGGCAGGCCAGGCCTGGCCGTGA
ACGTTCACTGAAATCATGGCCTCTTGGCCAAGATTGATAGCTTG
TGCCTGTCCCTGAGTCCCAGTCCATCACGAGCAGCTGGTTTCTA
AGATGCTATTTCCCGTATAAAGCATGAGACCGTGACTTGCCAG
CCCCACAGAGCCCCGCCCTTGTCCATCACTGGCATCTGGACTCC
AGCCTGGGTTGGGCAAAGAGGGAAATGAGATCATGTCCTAAC
CCTGATCCTCTTGTCCCACAGATATCCAGAACCCTGACCCTGCC
GTGTACCAGCTGAGAGACTCTAAATCCAGTGACAAGTCTGTCT
GCCTATTCACCGATTTTGATTCTCAAACAAATGTGTCACAAAGT
AAGGATTCTGATGTGTATATCACAGACAAAACTGTGCTAGACA |

TABLE 35-continued

Donor Template Nucleotide Sequences-Left Homology Arm to Right Homology Arm

| SEQ ID NO: | Description | Sequence |
|---|---|---|
| | | TGAGGTCTATGGACTTCAGGCTCCGGTGCCCGTCAGTGGGCAG
AGCGCACATCGCCCACAGTCCCCGAGAAGTTGGGGGGAGGGG
TCGGCAATTGAACCGGTGCCTAGAGAAGGTGGCGCGGGGTAA
ACTGGGAAAGTGATGTCGTGTACTGGCTCCGCCTTTTTCCCGAG
GGTGGGGGAGAACCGTATATAAGTGCAGTAGTCGCCGTGAACG
TTCTTTTTCGCAACGGGTTTGCCGCCAGAACACAGGTAAGTGCC
GTGTGTGGTTCCCGCGGGCCTGGCCTCTTTACGGGTTATGGCCC
TTGCGTGCCTTGAATTACTTCCACTGGCTGCAGTACGTGATTCT
TGATCCCGAGCTTCGGGTTGGAAGTGGGTGGGAGAGTTCGAGG
CCTTGCGCTTAAGGAGCCCCTTCGCCTCGTGCTTGAGTTGAGGC
CTGGCCTGGGCGCTGGGGCCGCCGCGTGCGAATCTGGTGGCAC
CTTCGCGCCTGTCTCGCTGCTTTCGATAAGTCTCTAGCCATTTA
AAATTTTTGATGACCTGCTGCGACGCTTTTTTTCTGGCAAGATA
GTCTTGTAAATGCGGGCCAAGATCTGCACACTGGTATTTCGGTT
TTTGGGGCCGCGGGCGGCGACGGGGCCCGTGCGTCCCAGCGCA
CATGTTCGGCGAGGCGGGGCCTGCGAGCGCGGCCACCGAGAAT
CGGACGGGGGTAGTCTCAAGCTGGCCGGCCTGCTCTGGTGCCT
GGCCTCGCGCCGCCGTGTATCGCCCCGCCCTGGGCGGCAAGGC
TGGCCCGGTCGGCACCAGTTGCGTGAGCGGAAAGATGGCCGCT
TCCCGGCCCTGCTGCAGGGAGCTCAAAATGGAGGACGCGGCGC
TCGGGAGAGCGGGCGGGTGAGTCACCCACACAAAGGAAAAGG
GCCTTTCCGTCCTCAGCCGTCGCTTCATGTGACTCCACGGAGTA
CCGGGCGCCGTCCAGGCACCTCGATTAGTTCTCGAGCTTTTGGA
GTACGTCGTCTTTAGGTTGGGGGGAGGGGTTTTATGCGATGGA
GTTTCCCCACACTGAGTGGGTGGAGACTGAAGTTAGGCCAGCT
TGGCACTTGATGTAATTCTCCTTGGAATTTGCCCTTTTTGAGTTT
GGATCTTGGTTCATTCTCAAGCCTCAGACAGTGGTTCAAAGTTT
TTTTCTTCCATTTCAGGTGTCGTGACCACCATGGCGCTTCCGGT
GACAGCACTGCTCCTCCCCTTGGCGCTGTTGCTCCACGCAGCAA
GGCCGGATATCCAGATGACCCAGGCCACCAGCAGCCTGAGCGC
TTCCCTCGGCGACAGGGTGACCATCAACTGCAGGACCAGCCAG
GACATCTCCAACCACCTGAACTGGTACCAGCAGAAGCCCGACG
GCACCGTGAAACTGCTGATCTACTACACCAGCAGACTGCAGAG
CGGCGTGCCCTCCAGATTTTCCGGCAGCGGCTCCGGCACCGAC
TACAGCCTGACCATTAGCAACCTGGAGCAGGAGGACATCGGAA
CCTACTTCTGCCACCAGGGCAACACACTGCCTCCCACCTTCGGC
GGCGGCACAAAGCTCGAGATCAAGGGCGGCGGCGGAAGCGGC
GGCGGCGGCAGCGGCGGCGGAGGCTCCGAGGTGCAACTGCAA
CAGAGCGGACCTGAGCTGGTGAAGCCTGGCGCCAGCGTGAAG
ATCTCCTGTAAGACCAGCGGCTACACCTTCACCGAGTACACCA
TCAACTGGGTGAAGCAGAGCCACGGCAAGAGCCTCGAATGGA
TCGGCGACATCTATCCCGACAACTACAATATCAGATACAACCA
GAAGTTCAAGGGAAAGGCCACCCTGACCGTGGATAAGTCCTCC
TCCACCGCTTACATGGAGCTGAGGAGCCTGAGCAGCGAGGACT
CCGCCATCTACTACTGCGCCAACCACGACTTCTTCGTGTTCTGG
GGCCAAGGCACCCTCGTGACCGTGAGCGCCAGTGCTGCTGCCT
TTGTCCCGGTATTTCTCCCAGCCAAACCGACCACGACTCCCGCC
CCGCGCCCTCCGACACCCGCTCCCACCATCGCCTCTCAACCTCT
TAGTCTTCGCCCCGAGGCATGCCGACCCGCCGCCGGGGGTGCT
GTTCATACGAGGGGCTTGGACTTCGCTTGTGATATTTACATTTG
GGCTCCGTTGGCGGGTACGTGCGGCGTCCTTTTGTTGTCACTCG
TTATTACTTTGTATTGTAATCACAGGAATCGCTCAAAGCGGAGT
AGGTTGTTGCATTCCGATTACATGAATATGACTCCTCGCCGGCC
TGGGCCGACAAGAAAACATTACCAACCCTATGCCCCCCCACGA
GACTTCGCTGCGTACAGGTCCCGAGTGAAGTTTTCCCGAAGCG
CAGACGCTCCGGCATATCAGCAAGGACAGAATCAGCTGTATAA
CGAACTGAATTTGGGACGCCGCGAGGAGTATGACGTGCTTGAT
AAACGCCGGGGAGAGACCCGGAAATGGGGGTAAACCCCGA
AGAAAGAATCCCCAAGAAGGACTCTACAATGAACTCCAGAAG
GATAAGATGGCGGAGGCCTACTCAGAAATAGGTATGAAGGGC
GAACGACGACGGGGAAAAGGTCACGATGGCCTCTACCAAGGG
TTGAGTACGGCAACCAAAGATACGTACGATGCACTGCATATGC
AGGCCCTGCCTCCCAGATAATAATAAAATCGCTATCCATCGAA
GATGGATGTGTGTTGGTTTTTTGTGTGTGGAGCAACAAATCTGA
CTTTGCATGTGCAAACGCCTTCAACAACAGCATTATTCCAGAA
GACACCTTCTTCCCCAGCCCAGGTAAGGGCAGCTTTGGTGCCTT
CGCAGGCTGTTTCCTTGCTTCAGGAATGGCCAGGTTCTGCCCAG
AGCTCTGGTCAATGATGTCTAAAACTCCTCTGATTGGTGGTCTC
GGCCTTATCCATTGCCACCAAAACCCTCTTTTTACTAAGAAACA
GTGAGCCTTGTTCTGGCAGTCAGAGAATGACACGGGAAAAAA
GCAGATGAAGAGAAGGTGGCAGGAGAGGGCACGTGGCCCAGC
CTCAGTCTCTCCAACTGAGTTCCTGCCTGCCTGCCTTTGCTCAG
ACTGTTTGCCCCTTACTGCTCTTCTAGGCCTCATTCTAAGCCCCT
TCTCCAAGTTGCCTCTCCTTATTTCTCCCTGTCTGCCAAAAAAT
CTTTCCCAGCTCACTAAGTCAGTCTCACGCAGTCACTCATTAAC |

TABLE 35-continued

Donor Template Nucleotide Sequences-Left Homology Arm to Right Homology Arm

| SEQ ID NO: | Description | Sequence |
|---|---|---|
| | | CCACCAATCACTGATTGTGCCGGCACATGAATGCACCAGGTGT
TGAAGTGGAGGAATTAAAAAGTCAGATGAGGGGTGTGCCCAG
AGGAAGCACCATTCTAGTTGGGGGAGCCCATCTGTCAGCTGGG
AAAAGTCCAAATAACTTCAGATTGGAATGTGTTTTAACTCAGG
GTTGAGAAAACAGCTACCTTCAGGACAAAAGTCAGGGAAGGG
CTCTCTGAAGAAATGCTACTTGAAGATACCAGCCCTACCAAGG
GCAGGGAGAGGACCCTATAGAGGCCTGGGACAGGAGCTCAAT
GAGAAAGG |
| 1415 | LHA to RHA of CTX-172 | GAGATGTAAGGAGCTGCTGTGACTTGCTCAAGGCCTTATATCG
AGTAAACGGTAGTGCTGGGGCTTAGACGCAGGTGTTCTGATTT
ATAGTTCAAAACCTCTATCAATGAGAGAGCAATCTCCTGGTAA
TGTGATAGATTTCCCAACTTAATGCCAACATACCATAAACCTCC
CATTCTGCTAATGCCCAGCCTAAGTTGGGGAGACCACTCCAGA
TTCCAAGATGTACAGTTTGCTTTGCTGGGCCTTTTTCCCATGCC
TGCCTTTACTCTGCCAGAGTTATATTGCTGGGGTTTTGAAGAAG
ATCCTATTAAATAAAAGAATAAGCAGTATTATTAAGTAGCCCT
GCATTTCAGGTTTCCTTGAGTGGCAGGCCAGGCCTGGCCGTGA
ACGTTCACTGAAATCATGGCCTCTTGGCCAAGATTGATAGCTTG
TGCCTGTCCCTGAGTCCCAGTCCATCACGAGCAGCTGGTTTCTA
AGATGCTATTTCCCGTATAAAGCATGAGACCGTGACTTGCCAG
CCCCACAGAGCCCCGCCCTTGTCCATCACTGGCATCTGGACTCC
AGCCTGGGTTGGGGCAAAGAGGGAAATGAGATCATGTCCTAAC
CCTGATCCTCTTGTCCCACAGATATCCAGAACCCTGACCCTGCC
GTGTACCAGCTGAGAGACTCTAAATCCAGTGACAAGTCTGTCT
GCCTATTCACCGATTTTGATTCTCAAACAAATGTGTCACAAAGT
AAGGATTCTGATGTGTATATCACAGACAAAACTGTGCTAGACA
TGAGGTCTATGGACTTCAGGCTCCGGTGCCCGTCAGTGGGCAG
AGCGCACATCGCCCACAGTCCCCGAGAAGTTGGGGGGAGGGG
TCGGCAATTGAACCGGTGCCTAGAGAAGGTGGCGCGGGGTAA
ACTGGGAAAGTGATGTCGTGTACTGGCTCCGCCTTTTTCCCGAG
GGTGGGGGAGAACCGTATATAAGTGCAGTAGTCGCCGTGAACG
TTCTTTTTCGCAACGGGTTTGCCGCCAGAACACAGGTAAGTGCC
GTGTGTGGTTCCCGCGGGCCTGGCCTCTTTACGGGTTATGGCCC
TTGCGTGCCTTGAATTACTTCCACTGGCTGCAGTACGTGATTCT
TGATCCCGAGCTTCGGGTTGGAAGTGGGTGGGAGAGTTCGAGG
CCTTGCGCTTAAGGAGCCCCTTCGCCTCGTGCTTGAGTTGAGGC
CTGGCCTGGGCGCTGGGGCCGCCGCGTGCGAATCTGGTGGCAC
CTTCGCGCCTGTCTCGCTGCTTTCGATAAGTCTCTAGCCATTTA
AAATTTTTGATGACCTGCTGCGACGCTTTTTTTCTGGCAAGATA
GTCTTGTAAATGCGGGCCAAGATCTGCACACTGGTATTTCGGTT
TTTGGGGCCGCGGGCGGCGACGGGGCCCGTGCGTCCCAGCGCA
CATGTTCGGCGAGGCGGGGCCTGCGAGCGCGGCCACCGAGAAT
CGGACGGGGGTAGTCTCAAGCTGGCCGGCCTGCTCTGGTGCCT
GGCCTCGCGCCGCCGTGTATCGCCCCGCCCTGGGCGGCAAGGC
TGGCCCGGTCGGCACCAGTTGCGTGAGCGGAAAGATGGCCGCT
TCCCGGCCCTGCTGCAGGGAGCTCAAAATGGAGGACGCGGCGC
TCGGGAGAGCGGGCGGGTGAGTCACCCACACAAAGGAAAAGG
GCCTTTCCGTCCTCAGCCGTCGCTTCATGTGACTCCACGGAGTA
CCGGGCGCCGTCCAGGCACCTCGATTAGTTCTCGAGCTTTTGGA
GTACGTCGTCTTTAGGTTGGGGGGAGGGGTTTTATGCGATGGA
GTTTCCCCACACTGAGTGGGTGGAGACTGAAGTTAGGCCAGCT
TGGCACTTGATGTAATTCTCCTTGGAATTTGCCCTTTTTGAGTTT
GGATCTTGGTTCATTCTCAAGCCTCAGACAGTGGTTCAAAGTTT
TTTTCTTCCATTTCAGGTGTCGTGACCACCATGGCGCTTCCGGT
GACAGCACTGCTCCTCCCCTTGGCGCTGTTGCTCCACGCAGCAA
GGCCGCAGGTGCAGCTGGTGCAGTCCGGCGCTGAGCTGAAGAA
GCCCGGCGCCAGCGTGAAGATCAGCTGCAAGGCCAGCGGCTAC
ACCTTCACCGAATACACCATCAACTGGGTGAGACAGGCCCCTG
GACAGAGGCTCGAGTGGATGGGCGACATCTACCCCGACAACTA
CAGCATCAGGTACAACCAGAAGTTCCAGGGCAGGGTGACAATC
ACCAGGGACACCAGCGCCAGCACCGCCTATATGGAGCTGACA
GCCTGAGATCCGAGGACACCGCCGTCTATTACTGCGCCAACCA
CGACTTCTTCGTGTTCTGGGGCCAGGGAACACTGGTGACCGTG
TCCAGCGGCGGCGGCGGCAGCGGCGGCGGAGGAAGCGGCGGC
GGCGGCAGCGGCGATATCCAGATGACCCAGAGCCCCTCCTCCCTGA
GCGCTAGCGTGGGCGACAGGGTGACCATTACCTGTCAGGCCTC
CCAGGACATCAGCAACTACCTGAACTGGTACCAGCAGAAGCCT
GGCAAGGCCCCCAAGCTGCTGATCTATTACACCAGCAGGCTGG
AGACCGGCGTGCCCTCCAGATTCAGCGGCTCCGGCTCCGGAAC
CGACTTCACCTTCACCATCAGCTCCCTGCAGCCTGAGGACATCG
CCACCTACTACTGCCAGCAGGGCAACACCCTGCCTCCCACATT
CGGCGGCGGCACAAAGGTGGAGATCAAAAGTGCTGCTGCCTTT
GTCCCGGTATTTCTCCCAGCCAAACCGACCACGACTCCCGCCCC
GCGCCCTCCGACACCCGCTCCCACCATCGCCTCTCAACCTCTTA |

TABLE 35-continued

Donor Template Nucleotide Sequences-Left Homology Arm to Right Homology Arm

| SEQ ID NO: | Description | Sequence |
|---|---|---|
| | | GTCTTCGCCCCGAGGCATGCCGACCCGCCGCCGGGGGTGCTGT
TCATACGAGGGGCTTGGACTTCGCTTGTGATATTTACATTTGGG
CTCCGTTGGCGGGTACGTGCGGCGTCCTTTTGTTGTCACTCGTT
ATTACTTTGTATTGTAATCACAGGAATCGCTCAAAGCGGAGTA
GGTTGTTGCATTCCGATTACATGAATATGACTCCTCGCCGGCCT
GGGCCGACAAGAAAACATTACCAACCCTATGCCCCCCCACGAG
ACTTCGCTGCGTACAGGTCCCGAGTGAAGTTTTCCCGAAGCGC
AGACGCTCCGGCATATCAGCAAGGACAGAATCAGCTGTATAAC
GAACTGAATTTGGGACGCCGCGAGGAGTATGACGTGCTTGATA
AACGCCGGGGAGAGACCCGGAAATGGGGGTAAACCCCGAA
GAAAGAATCCCCAAGAAGGACTCTACAATGAACTCCAGAAGG
ATAAGATGGCGGAGGCCTACTCAGAAATAGGTATGAAGGGCG
AACGACGACGGGGAAAAGGTCACGATGGCCTCTACCAAGGGT
TGAGTACGGCAACCAAAGATACGTACGATGCACTGCATATGCA
GGCCCTGCCTCCCAGATAATAATAAAATCGCTATCCATCGAAG
ATGGATGTGTGTTGGTTTTTTGTGTGGAGCAACAAATCTGAC
TTTGCATGTGCAAACGCCTTCAACAACAGCATTATTCCAGAAG
ACACCTTCTTCCCCAGCCCAGGTAAGGGCAGCTTTGGTGCCTTC
GCAGGCTGTTTCCTTGCTTCAGGAATGGCCAGGTTCTGCCCAGA
GCTCTGGTCAATGATGTCTAAAACTCCTCTGATTGGTGGTCTCG
GCCTTATCCATTGCCACCAAAACCCTCTTTTTACTAAGAAACAG
TGAGCCTTGTTCTGGCAGTCCAGAGAATGACACGGGAAAAAG
CAGATGAAGAGAAGGTGGCAGGAGAGGGCACGTGGCCCAGCC
TCAGTCTCTCCAACTGAGTTCCTGCCTGCCTGCCTTTGCTCAGA
CTGTTTGCCCCTTACTGCTCTTCTAGGCCTCATTCTAAGCCCCTT
CTCCAAGTTGCCTCTCCTTATTTCTCCCTGTCTGCCAAAAAATC
TTTCCCAGCTCACTAAGTCAGTCTCACGCAGTCACTCATTAACC
CACCAATCACTGATTGTGCCGGCACATGAATGCACCAGGTGTT
GAAGTGGAGGAATTAAAAAGTCAGATGAGGGGTGTGCCCAGA
GGAAGCACCATTCTAGTTGGGGGAGCCCATCTGTCAGCTGGGA
AAAGTCCAAATAACTTCAGATTGGAATGTGTTTTAACTCAGGG
TTGAGAAAACAGCTACCTTCAGGACAAAAGTCAGGGAAGGGC
TCTCTGAAGAAATGCTACTTGAAGATACCAGCCCTACCAAGGG
CAGGGAGAGGACCCTATAGAGGCCTGGGACAGGAGCTCAATG
AGAAAGG |
| 1416 | LHA to RHA of CTX-173 | GAGATGTAAGGAGCTGCTGTGACTTGCTCAAGGCCTTATATCG
AGTAAACGGTAGTGCTGGGGCTTAGACGCAGGTGTTCTGATTT
ATAGTTCAAAACCTCTATCAATGAGAGAGCAATCTCCTGGTAA
TGTGATAGATTTCCCAACTTAATGCCAACATACCATAAACCTCC
CATTCTGCTAATGCCCAGCCTAAGTTGGGGAGACCACTCCAGA
TTCCAAGATGTACAGTTTGCTTTGCTGGGCCTTTTTCCCATGCC
TGCCTTTACTCTGCCAGAGTTATATTGCTGGGGTTTTGAAGAAG
ATCCTATTAAATAAAAGAATAAGCAGTATTATTAAGTAGCCCT
GCATTTCAGGTTTCCTTGAGTGGCAGGCCAGGCCTGGCCGTGA
ACGTTCACTGAAATCATGGCCTCTTGGCCAAGATTGATAGCTTG
TGCCTGTCCCTGAGTCCCAGTCCATCACGAGCAGCTGGTTTCTA
AGATGCTATTTCCCGTATAAAGCATGAGACCGTGACTTGCCAG
CCCCACAGAGCCCCGCCCTTGTCCATCACTGGCATCTGGACTCC
AGCCTGGGTTGGGGCAAAGAGGGAAATGAGATCATGTCCTAAC
CCTGATCCTCTTGTCCCACAGATATCCAGAACCCTGACCCTGCC
GTGTACCAGCTGAGAGACTCTAAATCCAGTGACAAGTCTGTCT
GCCTATTCACCGATTTTGATTCTCAAACAAATGTGTCACAAAGT
AAGGATTCTGATGTGTATATCACAGACAAAACTGTGCTAGACA
TGAGGTCTATGGACTTCAGGCTCCGGTGCCCGTCAGTGGGCAG
AGCGCACATCGCCCACAGTCCCCGAGAAGTTGGGGGGAGGGG
TCGGCAATTGAACCGGTGCCTAGAGAAGGTGGCGCGGGGTAA
ACTGGGAAAGTGATGTCGTGTACTGGCTCCGCCTTTTTCCCGAG
GGTGGGGGAGAACCGTATATAAGTGCAGTAGTCGCCGTGAACG
TTCTTTTTCGCAACGGGTTTGCCGCCAGAACACAGGTAAGTGCC
GTGTGTGGTTCCCGCGGGCCTGGCCTCTTTACGGGTTATGGCCC
TTGCGTGCCTTGAATTACTTCCACTGGCTGCAGTACGTGATTCT
TGATCCCGAGCTTCGGGTTGGAAGTGGGTGGGAGAGTTCGAGG
CCTTGCGCTTAAGGAGCCCCTTCGCCTCGTGCTTGAGTTGAGGC
CTGGCCTGGGCGCTGGGGCCGCCGCGTGCGAATCTGGTGGCAC
CTTCGCGCCTGTCTCGCTGCTTTCGATAAGTCTCTAGCCATTTA
AAATTTTTGATGACCTGCTGCGACGCTTTTTTTCTGGCAAGATA
GTCTTGTAAATGCGGGCCAAGATCTGCACACTGGTATTTCGGTT
TTTGGGCGCGGGCGGCGACGGGCCCGTGCGTCCCAGCGCA
CATGTTCGGCAGGCGGGCCTGCGAGCGCGGCCACCGAGAAT
CGGACGGGGGTAGTCTCAAGCTGGCCGGCCTGCTCTGGTGCCT
GGCCTCGCGCCGCCGTGTATCGCCCCGCCCTGGGCGGCAAGGC
TGGCCCGGTCGGCACCAGTTGCGTGAGCGGAAAGATGGCCGCT
TCCCGGCCCTGCTGCAGGGAGCTCAAAATGGAGGACGCGGCGC
TCGGGAGAGCGGGCGGGTGAGTCACCCACACAAAGGAAAAGG |

TABLE 35-continued

Donor Template Nucleotide Sequences-Left Homology Arm to Right Homology Arm

| SEQ ID NO: | Description | Sequence |
|---|---|---|
| | | GCCTTTCCGTCCTCAGCCGTCGCTTCATGTGACTCCACGGAGTA<br>CCGGGCGCCGTCCAGGCACCTCGATTAGTTCTCGAGCTTTTGGA<br>GTACGTCGTCTTTAGGTTGGGGGGAGGGGTTTTATGCGATGGA<br>GTTTCCCCACACTGAGTGGGTGGAGACTGAAGTTAGGCCAGCT<br>TGGCACTTGATGTAATTCTCCTTGGAATTTGCCCTTTTTGAGTTT<br>GGATCTTGGTTCATTCTCAAGCCTCAGACAGTGGTTCAAAGTTT<br>TTTTCTTCCATTTCAGGTGTCGTGACCACCATGGCGCTTCCGGT<br>GACAGCACTGCTCCTCCCCTTGGCGCTGTTGCTCCACGCAGCAA<br>GGCCGCAGGTGCAGCTGGTCCAGTCCGGCGCCGAACTGAAGAA<br>GCCTGGCGCCAGCGTGAAGATCAGCTGCAAGGCCTCCGGCTAC<br>ACCTTCACCGAGTACACCATCAACTGGGTGAGGCAAGCCCCCG<br>GCCAGAGACTGGAGTGGATGGGCGACATCTACCCCGACAACTA<br>CAGCATCAGGTACAACCAGAAGTTCCAGGGCAGGGTGACAATC<br>ACCAGGGATACCAGCGCCAGCACAGCCTATATGGAGCTGTCCT<br>CCCTGAGATCCGAGGACACCGCCGTGTATTACTGCGCCAACCA<br>CGACTTCTTCGTGTTCTGGGGCCAAGGCACCCTGGTGACCGTG<br>AGCAGCGGCGGCGGCGGCTCCGGCGGCGGAGGCTCCGGAGGC<br>GGAGGCAGCGACATCCAGATGACCCAGAGCCCTTCCAGCCTGA<br>GCGCTAGCCTGGGCGACAGGGTGACCATCACCTGCAGGACCAG<br>CCAGGACATCAGCAATCACCTGAACTGGTACCAGCAAAAGCCC<br>GGCAAGGCCCCTAAGCTGCTGATCTACTACACCAGCAGGCTGG<br>AAAGCGGCGTGCCTAGCAGGTTCAGCGGCAGCGGCTCCGGAAC<br>CGACTACAGCCTGACCATTAGCAGCCTGCAACCTGAGGACATC<br>GGCACCTATTACTGCCAGCAGGGCAACACCCTGCCTCCTACCTT<br>TGGCGGCGGCACCAAACTCGAGATCAAGAGTGCTGCTGCCTTT<br>GTCCCGGTATTTCTCCCAGCCAAACCGACCACGACTCCCGCCCC<br>GCGCCCTCCGACACCCGCTCCCACCATCGCCTCTCAACCTCTTA<br>GTCTTCGCCCCGAGGCATGCCGACCCGCCGCCGGGGTGCTGT<br>TCATACGAGGGGCTTGGACTTCGCTTGTGATATTTACATTTGGG<br>CTCCGTTGGCGGGTACGTGCGGCGTCCTTTTGTTGTCACTCGTT<br>ATTACTTTGTATTGTAATCACAGGAATCGCTCAAAGCGGAGTA<br>GGTTGTTGCATTCCGATTACATGAATATGACTCCTCGCCGGCCT<br>GGGCCGACAAGAAAACATTACCAACCCTATGCCCCCCACGAG<br>ACTTCGCTGCGTACAGGTCCCGAGTGAAGTTTTCCCGAAGCGC<br>AGACGCTCCGGCATATCAGCAAGGACAGAATCAGCTGTATAAC<br>GAACTGAATTTGGGACGCCGCGAGGAGTATGACGTGCTTGATA<br>AACGCCGGGGAGAGACCCGGAAATGGGGGGTAAACCCCGAA<br>GAAAGAATCCCCAAGAAGGACTCTACAATGAACTCCAGAAGG<br>ATAAGATGGCGGAGGCCTACTCAGAAATAGGTATGAAGGGCG<br>AACGACGACGGGGAAAAGGTCACGATGGCCTCTACCAAGGGT<br>TGAGTACGGCAACCAAAGATACGTACGATGCACTGCATATGCA<br>GGCCCTGCCTCCCAGATAATAATAAAATCGCTATCCATCGAAG<br>ATGGATGTGTGTTGGTTTTTTGTGTGTGGAGCAACAAATCTGAC<br>TTTGCATGTGCAAACGCCTTCAACAACAGCATTATTCCAGAAG<br>ACACCTTCTTCCCCAGCCCAGGTAAGGGCAGCTTTGGTGCCTTC<br>GCAGGCTGTTTCCTTGCTTCAGGAATGGCCAGGTTCTGCCCAGA<br>GCTCTGGTCAATGATGTCTAAAACTCCTCTGATTGGTGGTCTCG<br>GCCTTATCCATTGCCACCAAAACCCTCTTTTTACTAAGAAACAG<br>TGAGCCTTGTTCTGGCAGTCCAGAGAATGACACGGGAAAAAAG<br>CAGATGAAGAGAAGGTGGCAGGAGAGGGCACGTGGCCCAGCC<br>TCAGTCTCTCCAACTGAGTTCCTGCCTGCCTGCCTTTGCTCAGA<br>CTGTTTGCCCCTTACTGCTCTTCTAGGCCTCATTCTAAGCCCCTT<br>CTCCAAGTTGCCTCTCCTTATTTCTCCCTGTCTGCCAAAAAATC<br>TTTCCCAGCTCACTAAGTCAGTCTCACGCAGTCACTCATTAACC<br>CACCAATCACTGATTGTGCCGGCACATGAATGCACCAGGTGTT<br>GAAGTGGAGGAATTAAAAAGTCAGATGAGGGGTGTGCCCAGA<br>GGAAGCACCATTCTAGTTGGGGGAGCCCATCTGTCAGCTGGGA<br>AAAGTCCAAATAACTTCAGATTGGAATGTGTTTTAACTCAGGG<br>TTGAGAAAACAGCTACCTTCAGGACAAAAGTCAGGGAAGGGC<br>TCTCTGAAGAAATGCTACTTGAAGATACCAGCCCTACCAAGGG<br>CAGGGAGAGGACCCTATAGAGGCCTGGGACAGGAGCTCAATG<br>AGAAAGG |
| 1417 | LHA to RHA of CTX-174 | GAGATGTAAGGAGCTGCTGTGACTTGCTCAAGGCCTTATATCG<br>AGTAAACGGTAGTGCTGGGGCTTAGACGCAGGTGTTCTGATTT<br>ATAGTTCAAAACCTCTATCAATGAGAGCAATCTCCTGGTAA<br>TGTGATAGATTTCCCAACTTAATGCCAACATACCATAAACCTCC<br>CATTCTGCTAATGCCCAGCCTAAGTTGGGGAGACCACTCCAGA<br>TTCCAAGATGTACAGTTTGCTTTGCTGGGCCTTTTTCCCATGCC<br>TGCCTTTACTCTGCCAGAGTTATATTGCTGGGGTTTTGAAGAAG<br>ATCCTATTAAATAAAAGAATAAGCAGTATTATTAAGTAGCCCT<br>GCATTTCAGGTTTCCTTGAGTGGCAGGCCAGGCCTGGCCGTGA<br>ACGTTCACTGAAATCATGGCCTCTTGGCCAAGATTGATAGCTTG<br>TGCCTGTCCCTGAGTCCCAGTCCATCACGAGCAGCTGGTTTCTA<br>AGATGCTATTTCCCGTATAAAGCATGAGACCGTGACTTGCCAG |

TABLE 35-continued

Donor Template Nucleotide Sequences-Left Homology Arm to Right Homology Arm

| SEQ ID NO: | Description | Sequence |
|---|---|---|
| | | CCCCACAGAGCCCCGCCCTTGTCCATCACTGGCATCTGGACTCC
AGCCTGGGTTGGGGCAAAGAGGGAAATGAGATCATGTCCTAAC
CCTGATCCTCTTGTCCCACAGATATCCAGAACCCTGACCCTGCC
GTGTACCAGCTGAGAGACTCTAAATCCAGTGACAAGTCTGTCT
GCCTATTCACCGATTTTGATTCTCAAACAAATGTGTCACAAAGT
AAGGATTCTGATGTGTATATCACAGACAAAACTGTGCTAGACA
TGAGGTCTATGGACTTCAGGCTCCGGTGCCCGTCAGTGGGCAG
AGCGCACATCGCCCACAGTCCCCGAGAAGTTGGGGGGAGGGG
TCGGCAATTGAACCGGTGCCTAGAGAAGGTGGCGCGGGGTAA
ACTGGGAAAGTGATGTCGTGTACTGGCTCCGCCTTTTTCCCGAG
GGTGGGGGAGAACCGTATATAAGTGCAGTAGTCGCCGTGAACG
TTCTTTTTCGCAACGGGTTTGCCGCCAGAACACAGGTAAGTGCC
GTGTGTGGTTCCCGCGGGCCTGGCCTCTTTACGGGTTATGGCCC
TTGCGTGCCTTGAATTACTTCCACTGGCTGCAGTACGTGATTCT
TGATCCCGAGCTTCGGGTTGGAAGTGGGTGGGAGAGTTCGAGG
CCTTGCGCTTAAGGAGCCCCTTCGCCTCGTGCTTGAGTTGAGGC
CTGGCCTGGGCGCTGGGGCCGCCGCGTGCGAATCTGGTGGCAC
CTTCGCGCCTGTCTCGCTGCTTTCGATAAGTCTCTAGCCATTTA
AAATTTTTGATGACCTGCTGCGACGCTTTTTTTCTGGCAAGATA
GTCTTGTAAATGCGGGCCAAGATCTGCACACTGGTATTTCGGTT
TTTGGGGCCGCGGGCGGCGACGGGGCCCGTGCGTCCCAGCGCA
CATGTTCGGCGAGGCGGGGCCTGCGAGCGCGGCCACCGAGAAT
CGGACGGGGGTAGTCTCAAGCTGGCCGGCCTGCTCTGGTGCCT
GGCCTCGCGCCGCCGTGTATCGCCCCGCCCTGGGCGGCAAGGC
TGGCCCGGTCGGCACCAGTTGCGTGAGCGGAAAGATGGCCGCT
TCCCGGCCCTGCTGCAGGGAGCTCAAAATGGAGGACGCGGCGC
TCGGGAGAGCGGGCGGGTGAGTCACCCACACAAAGGAAAAGG
GCCTTTCCGTCCTCAGCCGTCGCTTCATGTGACTCCACGGAGTA
CCGGGCGCCGTCCAGGCACCTCGATTAGTTCTCGAGCTTTTGGA
GTACGTCGTCTTTAGGTTGGGGGGAGGGGTTTTATGCGATGGA
GTTTCCCCACACTGAGTGGGTGGAGACTGAAGTTAGGCCAGCT
TGGCACTTGATGTAATTCTCCTTGGAATTTGCCCTTTTTGAGTTT
GGATCTTGGTTCATTCTCAAGCCTCAGACAGTGGTTCAAAGTTT
TTTTCTTCCATTTCAGGTGTCGTGACCACCATGGCGCTTCCGGT
GACAGCACTGCTCCTCCCCTTGGCGCTGTTGCTCCACGCAGCAA
GGCCGCAGGTGCAGCTGGTGCAGAGCGGCCCTGAGCTGAAGA
AGCCCGGAGCCAGCGTGAAGATCTCCTGCAAGACCTCCGGCTA
CACCTTCACCGAGTACACCATCAACTGGGTGAAGCAGGCCCCC
GGACAGGGACTGGAATGGATCGGCGACATCTACCCCGACAACT
ACAACATCAGGTACAACCAGAAGTTCCAAGGCAAGGCCACCAT
CACAAGGGACACCAGCAGCAGCACCGCCTACATGGAGCTGAG
CAGCCTGAGGAGCGAGGATACCGCCGTGTACTACTGCGCCAAC
CACGACTTCTTCGTGTTCTGGGGCCAGGGCACCCTGGTGACAG
TGAGCAGCGGAGGAGGCGGAAGCGGAGGAGGAGGATCCGGAG
GAGGAGGCAGCGACATCCAGATGACCCAGTCCCCCTCCTCCCT
GAGCGCCTCCGTGGGAGACAGGGTGACCATCACCTGCCAGGCC
AGCCAGGACATCAGCAACTACCTGAACTGGTACCAGCAGAAGC
CCGGCAAGGCCCCCAAGCTGCTGATTTACTACACCAGCAGGCT
GGAAACCGGCGTGCCCAGCAGATTTAGCGGCAGCGGCAGCGG
CACCGACTTTACCTTTACCATCTCCAGCCTGCAGCCCGAGGATA
TCGCCACATACTACTGCCAGCAGGGCAACACCCTCCCCCCTAC
CTTTGGCGGCGGCACCAAGGTGGAGATTAAGAGTGCTGCTGCC
TTTGTCCCGGTATTTCTCCCAGCCAAACCGACCACGACTCCCGC
CCCGCGCCCTCCGACACCCGCTCCCACCATCGCCTCTCAACCTC
TTAGTCTTCGCCCCGAGGCATGCCGACCCGCCGCCGGGGGTGC
TGTTCATACGAGGGGCTTGGACTTCGCTTGTGATATTTACATTT
GGGCTCCGTTGGCGGGTACGTGCGGCGTCCTTTTGTTGTCACTC
GTTATTACTTTGTATTGTAATCACAGGAATCGCTCAAAGCGGA
GTAGGTTGTTGCATTCCGATTACATGAATATGACTCCTCGCCGG
CCTGGGCCGACAAGAAAACATTACCAACCCTATGCCCCCCCAC
GAGACTTCGCTGCGTACAGGTCCCGAGTGAAGTTTTCCCGAAG
CGCAGACGCTCCGGCATATCAGCAAGGACAGAATCAGCTGTAT
AACGAACTGAATTTGGGACGCCGCGAGGAGTATGACGTGCTTG
ATAAACGCCGGGGAGAGACCCGGAAATGGGGGTAAACCCC
GAAGAAAGAATCCCCAAGAAGGACTCTACAATGAACTCCAGA
AGGATAAGATGGCGGAGGCCTACTCAGAAATAGGTATGAAGG
GCGAACGACGACGGGGAAAAGGTCACGATGGCCTCTACCAAG
GGTTGAGTACGGCAACCAAAGATACGTACGATGCACTGCATAT
GCAGGCCCTGCCTCCCAGATAATAATAAAATCGCTATCCATCG
AAGATGGATGTGTGTTGGTTTTTTGTGTGTGGAGCAACAAATCT
GACTTTGCATGTGCAAACGCCTTCAACAACAGCATTATTCCAG
AAGACACCTTCTTCCCCAGCCCAGGTAAGGGCAGCTTTGGTGC
CTTCGCAGGCTGTTTCCTTGCTTCAGGAATGGCCAGGTTCTGCC
CAGAGCTCTGGTCAATGATGTCTAAAACTCCTCTGATTGGTGGT
CTCGGCCTTATCCATTGCCACCAAAACCCTCTTTTTACTAAGAA |

TABLE 35-continued

Donor Template Nucleotide Sequences-Left Homology Arm to Right Homology Arm

| SEQ ID NO: | Description | Sequence |
|---|---|---|
|  |  | ACAGTGAGCCTTGTTCTGGCAGTCCAGAGAATGACACGGGAAA<br>AAAGCAGATGAAGAGAAGGTGGCAGGAGAGGGCACGTGGCCC<br>AGCCTCAGTCTCTCCAACTGAGTTCCTGCCTGCCTGCCTTTGCT<br>CAGACTGTTTGCCCCTTACTGCTCTTCTAGGCCTCATTCTAAGC<br>CCCTTCTCCAAGTTGCCTCTCCTTATTTCTCCCTGTCTGCCAAAA<br>AATCTTTCCCAGCTCACTAAGTCAGTCTCACGCAGTCACTCATT<br>AACCCACCAATCACTGATTGTGCCGGCACATGAATGCACCAGG<br>TGTTGAAGTGGAGGAATTAAAAAGTCAGATGAGGGGTGTGCCC<br>AGAGGAAGCACCATTCTAGTTGGGGGAGCCCATCTGTCAGCTG<br>GGAAAAGTCCAAATAACTTCAGATTGGAATGTGTTTTAACTCA<br>GGGTTGAGAAAACAGCTACCTTCAGGACAAAAGTCAGGGAAG<br>GGCTCTCTGAAGAAATGCTACTTGAAGATACCAGCCCTACCAA<br>GGGCAGGGAGAGGACCCTATAGAGGCCTGGGACAGGAGCTCA<br>ATGAGAAAGG |
| 1418 | LHA to RHA of CTX-175 | GAGATGTAAGGAGCTGCTGTGACTTGCTCAAGGCCTTATATCG<br>AGTAAACGGTAGTGCTGGGGCTTAGACGCAGGTGTTCTGATTT<br>ATAGTTCAAAACCTCTATCAATGAGAGCAATCTCCTGGTAA<br>TGTGATAGATTTCCCAACTTAATGCCAACATACCATAAACCTCC<br>CATTCTGCTAATGCCCAGCCTAAGTTGGGGAGACCACTCCAGA<br>TTCCAAGATGTACAGTTTGCTTTGCTGGGCCTTTTTCCCATGCC<br>TGCCTTTACTCTGCCAGAGTTATATTGCTGGGGTTTTGAAGAAG<br>ATCCTATTAAATAAAAGAATAAGCAGTATTATTAAGTAGCCCT<br>GCATTTCAGGTTTCCTTGAGTGGCAGGCCAGGCCTGGCCGTGA<br>ACGTTCACTGAAATCATGGCCTCTTGGCCAAGATTGATAGCTTG<br>TGCCTGTCCCTGAGTCCCAGTCCATCACGAGCAGCTGGTTTCTA<br>AGATGCTATTTCCCGTATAAAGCATGAGACCGTGACTTGCCAG<br>CCCCACAGAGCCCCGCCCTTGTCCATCACTGGCATCTGGACTCC<br>AGCCTGGGTTGGGGCAAAGAGGGAAATGAGATCATGTCCTAAC<br>CCTGATCCTCTTGTCCCACAGATATCCAGAACCCTGACCCTGCC<br>GTGTACCAGCTGAGAGACTCTAAATCCAGTGACAAGTCTGTCT<br>GCCTATTCACCGATTTTGATTCTCAAACAAATGTGTCACAAAGT<br>AAGGATTCTGATGTGTATATCACAGACAAAACTGTGCTAGACA<br>TGAGGTCTATGGACTTCAGGCTCCGGTGCCCGTCAGTGGGCAG<br>AGCGCACATCGCCCACAGTCCCCGAGAAGTTGGGGGGAGGGG<br>TCGGCAATTGAACCGGTGCCTAGAGAAGGTGGCGCGGGGTAA<br>ACTGGGAAAGTGATGTCGTGTACTGGCTCCGCCTTTTTCCCGAG<br>GGTGGGGGAGAACCGTATATAAGTGCAGTAGTCGCCGTGAACG<br>TTCTTTTTCGCAACGGGTTTGCCGCCAGAACACAGGTAAGTGCC<br>GTGTGTGGTTCCCGCGGGCCTGGCCTCTTTACGGGTTATGGCCC<br>TTGCGTGCCTTGAATTACTTCCACTGGCTGCAGTACGTGATTCT<br>TGATCCCGAGCTTCGGGTTGGAAGTGGGTGGGAGAGTTCGAGG<br>CCTTGCGCTTAAGGAGCCCCTTCGCCTCGTGCTTGAGTTGAGGC<br>CTGGCCTGGGCGCTGGGGCCGCCGCGTGCGAATCTGGTGGCAC<br>CTTCGCGCCTGTCTCGCTGCTTTCGATAAGTCTCTAGCCATTTA<br>AAATTTTTGATGACCTGCTGCGACGCTTTTTTTCTGGCAAGATA<br>GTCTTGTAAATGCGGGCCAAGATCTGCACACTGGTATTTCGGTT<br>TTTGGGGCCGCGGGCGGCGACGGGGCCCGTGCGTCCCAGCGCA<br>CATGTTCGGCGAGGCGGGGCCTGCGAGCGCGGCCACCGAGAAT<br>CGGACGGGGGTAGTCTCAAGCTGGCCGGCCTGCTCTGGTGCCT<br>GGCCTCGCGCCGCCGTGTATCGCCCCGCCCTGGGCGGCAAGGC<br>TGGCCCGGTCGGCACCAGTTGCGTGAGCGGAAAGATGGCCGCT<br>TCCCGGCCCTGCTGCAGGGAGCTCAAAATGGAGGACGCGGCGC<br>TCGGGAGAGCGGGCGGGTGAGTCACCCACACAAAGGAAAAGG<br>GCCTTTCCGTCCTCAGCCGTCGCTTCATGTGACTCCACGGAGTA<br>CCGGGCGCCGTCCAGGCACCTCGATTAGTTCTCGAGCTTTTGGA<br>GTACGTCGTCTTTAGGTTGGGGGGAGGGGTTTTATGCGATGGA<br>GTTTCCCCACACTGAGTGGGTGGAGACTGAAGTTAGGCCAGCT<br>TGGCACTTGATGTAATTCTCCTTGGAATTTGCCCTTTTTGAGTTT<br>GGATCTTGGTTCATTCTCAAGCCTCAGACAGTGGTTCAAAGTTT<br>TTTTCTTCCATTTCAGGTGTCGTGACCACCATGGCGCTTCCGGT<br>GACAGCACTGCTCCTCCCCTTGGCGCTGTTGCTCCACGCAGCAA<br>GGCCGCAGGTGCAGCTGGTGCAGTCCGGCCCCGAACTGAAAAA<br>GCCCGGCGCCAGCGTCAAGATCAGCTGCAAGACCTCCGGCTAC<br>ACCTTCACCGAGTACACCATCAACTGGGTGAAGCAGGCCCCCG<br>GCCAGGGACTGGAATGGATTGGCGACATCTACCCCGACAACTA<br>CAACATTAGGTATAACCAGAAGTTCCAGGGCAAGGCCACCATC<br>ACAAGAGACACCAGCAGCAGCACCGCCTACATGGAGCTGAGC<br>AGCCTGAGGAGCGAGGACACCGCCGTGTACTACTGCGCCAACC<br>ACGACTTCTTCGTGTTCTGGGGCCAGGGAACCCTGGTGACAGT<br>GTCCAGCGGCGGCGGCGGCTCCGGCGGCGGCGGCTCCGGCGGC<br>GGCGGCAGCGACATTCAGATGACACAGAGCCCCTCCAGCCTGA<br>GCGCCAGCCTGGGCGATAGGGTGACCATCACCTGCAGAACCAG<br>CCAGGACATCAGCAACCACCTGAATTGGTACCAGCAGAAGCCC<br>GGAAAGGCCCCCAAACTGCTGATCTACTACACCAGCAGGCTGG |

TABLE 35-continued

Donor Template Nucleotide Sequences-Left Homology Arm to Right Homology Arm

| SEQ ID NO: | Description | Sequence |
|---|---|---|
| | | AGAGCGGCGTGCCTAGCAGGTTTAGCGGCAGCGGCAGCGGCA
CAGATTACAGCCTGACCATCAGCAGCCTGCAGCCCGAAGACAT
CGGCACCTACTACTGCCAGCAGGGCAACACCCTGCCCCCTACC
TTTGGCGGAGGCACCAAGCTGGAGATCAAGAGTGCTGCTGCCT
TTGTCCCGGTATTCTCCCAGCCAAACCGACCACGACTCCCGCC
CCGCGCCCTCCGACACCCGCTCCCACCATCGCCTCTCAACCTCT
TAGTCTTCGCCCCGAGGCATGCCGACCCGCCGCCGGGGGTGCT
GTTCATACGAGGGGCTTGGACTTCGCTTGTGATATTTACATTTG
GGCTCCGTTGGCGGGTACGTGCGGCGTCCTTTTGTTGTCACTCG
TTATTACTTTGTATTGTAATCACAGGAATCGCTCAAAGCGGAGT
AGGTTGTTGCATTCCGATTACATGAATATGACTCCTCGCCGGCC
TGGGCCGACAAGAAAACATTACCAACCCTATGCCCCCCACGA
GACTTCGCTGCGTACAGGTCCCGAGTGAAGTTTTCCCGAAGCG
CAGACGCTCCGGCATATCAGCAAGGACAGAATCAGCTGTATAA
CGAACTGAATTTGGGACGCCGCGAGGAGTATGACGTGCTTGAT
AAACGCCGGGGAGAGACCCGGAAATGGGGGGTAAACCCCGA
AGAAAGAATCCCCAAGAAGGACTCTACAATGAACTCCAGAAG
GATAAGATGCGGAGGCCTACTCAGAAATAGGTATGAAGGGC
GAACGACGACGGGGAAAAGGTCACGATGGCCTCTACCAAGGG
TTGAGTACGGCAACCAAAGATACGTACGATGCACTGCATATGC
AGGCCCTGCCTCCCAGATAATAATAAAATCGCTATCCATCGAA
GATGGATGTGTGTTGGTTTTTTGTGTGTGGAGCAACAAATCTGA
CTTTTGCATGTGCAAACGCCTTCAACAACAGCATTATTCCAGAA
GACACCTTCTTCCCCAGCCCAGGTAAGGGCAGCTTTGGTGCCTT
CGCAGGCTGTTTCCTTGCTTCAGGAATGGCCAGGTTCTGCCCAG
AGCTCTGGTCAATGATGTCTAAAACTCCTCTGATTGGTGGTCTC
GGCCTTATCCATTGCCACCAAAACCCTCTTTTTACTAAGAAACA
GTGAGCCTTGTTCTGGCAGTCCAGAGAATGACACGGGAAAAAA
GCAGATGAAGAGAAGGTGGCAGGAGAGGGCACGTGGCCCAGC
CTCAGTCTCTCCAACTGAGTTCCTGCCTGCCTGCCTTTGCTCAG
ACTGTTTGCCCCTTACTGCTCTTCTAGGCCTCATTCTAAGCCCCT
TCTCCAAGTTGCCTCTCCTTATTTCTCCCTGTCTGCCAAAAAAT
CTTTCCCAGCTCACTAAGTCAGTCTCACGCAGTCACTCATTAAC
CCACCAATCACTGATTGTGCCGGCACATGAATGCACCAGGTGT
TGAAGTGGAGGAATTAAAAAGTCAGATGAGGGGTGTGCCCAG
AGGAAGCACCATTCTAGTTGGGGGAGCCCATCTGTCAGCTGGG
AAAAGTCCAAATAACTTCAGATTGGAATGTGTTTTAACTCAGG
GTTGAGAAAACAGCTACCTTCAGGACAAAAGTCAGGGAAGGG
CTCTCTGAAGAAATGCTACTTGAAGATACCAGCCCTACCAAGG
GCAGGGAGAGGACCCTATAGAGGCCTGGGACAGGAGCTCAAT
GAGAAAGG |
| 1419 | LHA to RHA of CTX-176 | GAGATGTAAGGAGCTGCTGTGACTTGCTCAAGGCCTTATATCG
AGTAAACGGTAGTGCTGGGGCTTAGACGCAGGTGTTCTGATTT
ATAGTTCAAAACCTCTATCAATGAGAGAGCAATCTCCTGGTAA
TGTGATAGATTTCCCAACTTAATGCCAACATACCATAAACCTCC
CATTCTGCTAATGCCCAGCCTAAGTTGGGGAGACCACTCCAGA
TTCCAAGATGTACAGTTTGCTTTGCTGGGCCTTTTTCCCATGCC
TGCCTTTACTCTGCCAGAGTTATATTGCTGGGGTTTTGAAGAAG
ATCCTATTAAATAAAAGAATAAGCAGTATTATTAAGTAGCCCT
GCATTTCAGGTTTCCTTGAGTGGCAGGCCAGGCCTGGCCGTGA
ACGTTCACTGAAATCATGGCCTCTTGGCCAAGATTGATAGCTTG
TGCCTGTCCCTGAGTCCCAGTCCATCACGAGCAGCTGGTTTCTA
AGATGCTATTTCCCGTATAAAGCATGAGACCGTGACTTGCCAG
CCCCACAGAGCCCCGCCCTTGTCCATCACTGGCATCTGGACTCC
AGCCTGGGTTGGGCAAAGAGGGAAATGAGATCATGTCCTAAC
CCTGATCCTCTTGTCCCACAGATATCCAGAACCCTGACCCTGCC
GTGTACCAGCTGAGAGACTCTAAATCCAGTGACAAGTCTGTCT
GCCTATTCACCGATTTTGATTCTCAAACAAATGTGTCACAAAGT
AAGGATTCTGATGTGTATATCACAGACAAAACTGTGCTAGACA
TGAGGTCTATGGACTTCAGGCTCCGGTGCCCGTCAGTGGGCAG
AGCGCACATCGCCCACAGTCCCCGAGAAGTTGGGGGGAGGGG
TCGGCAATTGAACCGGTGCCTAGAGAAGGTGGCGCGGGGTAA
ACTGGGAAAGTGATGTCGTGTACTGGCTCCGCCTTTTTCCCGAG
GGTGGGGGAGAACCGTATATAAGTGCAGTAGTCGCCGTGAACG
TTCTTTTTCGCAACGGGTTTGCCGCCAGAACACAGGTAAGTGCC
GTGTGTGGTTCCCGCGGGCCTGGCCTCTTTACGGGTTATGGCCC
TTGCGTGCCTTGAATTACTTCCACTGGCTGCAGTACGTGATTCT
TGATCCCGAGCTTCGGGTTGGAAGTGGGTGGGAGAGTTCGAGG
CCTTCGCTTAAGGAGCCCCTTCGCCTCGTGCTTGAGTTGAGGC
CTGGCCTGGGCGCTGGGGCCGCCGCGTGCGAATCTGGTGGCAC
CTTCGCGCCTGTCTCGCTGCTTTCGATAAGTCTCTAGCCATTTA
AAATTTTTGATGACCTGCTGCGACGCTTTTTTTCTGGCAAGATA
GTCTTGTAAATGCGGGCCAAGATCTGCACACTGGTATTTCGGTT
TTTGGGGCCGCGGGCGGCGACGGGGCCCGTGCGTCCCAGCGCA |

TABLE 35-continued

Donor Template Nucleotide Sequences-Left Homology Arm to Right Homology Arm

| SEQ ID NO: | Description | Sequence |
|---|---|---|
| | | CATGTTCGGCGAGGCGGGGCCTGCGAGCGCGGCCACCGAGAAT<br>CGGACGGGGGTAGTCTCAAGCTGGCCGGCCTGCTCTGGTGCCT<br>GGCCTCGCGCCGCCGTGTATCGCCCCGCCCTGGGCGGCAAGGC<br>TGGCCCGGTCGGCACCAGTTGCGTGAGCGGAAAGATGGCCGCT<br>TCCCGGCCCTGCTGCAGGGAGCTCAAAATGGAGGACGCGGCGC<br>TCGGGAGAGCGGGCGGGTGAGTCACCCACACAAAGGAAAAGG<br>GCCTTTCCGTCCTCAGCCGTCGCTTCATGTGACTCCACGGAGTA<br>CCGGGCGCCGTCCAGGCACCTCGATTAGTTCTCGAGCTTTTGGA<br>GTACGTCGTCTTTAGGTTGGGGGGAGGGGTTTTATGCGATGGA<br>GTTTCCCCACACTGAGTGGGTGGAGACTGAAGTTAGGCCAGCT<br>TGGCACTTGATGTAATTCTCCTTGGAATTTGCCCTTTTTGAGTTT<br>GGATCTTGGTTCATTCTCAAGCCTCAGACAGTGGTTCAAAGTTT<br>TTTTCTTCCATTTCAGGTGTCGTGACCACCATGGCGCTTCCGGT<br>GACAGCACTGCTCCTCCCCTTGGCGCTGTTGCTCCACGCAGCAA<br>GGCCGGACATCCAGATGACACAGAGCCCTAGCAGCCTGAGCGC<br>TTCCGTGGGCGACAGGGTGACCATCACCTGCCAGGCCAGCCAG<br>GACATCAGCAACTACCTCAACTGGTACCAGCAGAAGCCCGGCA<br>AGGCCCCTAAGCTGCTGATCTACTACACCTCCAGGCTGGAGAC<br>CGGAGTGCCCTCCAGATTTTCCGGCAGCGGCAGCGGCACCGAT<br>TTCACCTTCACCATCAGCAGCCTGCAGCCCGAGGACATCGCCA<br>CCTACTATTGCCAGCAGGGCAACACCCTGCCCCCCACATTTGG<br>AGGCGGCACCAAGGTGGAGATCAAGGGCGGAGGAGGAAGCGG<br>AGGAGGAGGAAGCGGAGGAGGCGGAAGCCAGGTGCAGCTGGT<br>GCAGAGCGGCGCTGAGCTCAAGAAGCCTGGCGCCAGCGTGAA<br>GATCAGCTGCAAAGCCTCCGGATACACCTTCACCGAGTACACC<br>ATCAATTGGGTGAGACAGGCCCCCGGCCAAAGACTGGAGTGG<br>ATGGGCGACATCTATCCCGACAACTACAGCATCAGGTACAACC<br>AGAAGTTCCAGGGCAGGGTGACAATCACCAGAGACACCAGCG<br>CCAGCACCGCCTACATGGAGCTGAGCAGCCTGAGGAGCGAGG<br>ACACCGCCGTGTACTACTGCGCCAATCACGACTTCTTCGTGTTC<br>TGGGGCCAGGGAACCCTGGTGACCGTCAGCTCCAGTGCTGCTG<br>CCTTTGTCCCGGTATTTCTCCCAGCCAAACCGACCACGACTCCC<br>GCCCCGCGCCCTCCGACACCCGCTCCCACCATCGCCTCTCAACC<br>TCTTAGTCTTCGCCCCGAGGCATGCCGACCCGCCGCCGGGGGT<br>GCTGTTCATACGAGGGGCTTGGACTTCGCTTGTGATATTTACAT<br>TTGGGCTCCGTTGGCGGGTACGTGCGGCGTCCTTTTGTTGTCAC<br>TCGTTATTACTTTGTATTGTAATCACAGGAATCGCTCAAAGCGG<br>AGTAGGTTGTTGCATTCCGATTACATGAATATGACTCCTCGCCG<br>GCCTGGGCCGACAAGAAAACATTACCAACCCTATGCCCCCCCA<br>CGAGACTTCGCTGCGTACAGGTCCCGAGTGAAGTTTTCCCGAA<br>GCGCAGACGCTCCGGCATATCAGCAAGGACAGAATCAGCTGTA<br>TAACGAACTGAATTTGGGACGCCGCGAGGAGTATGACGTGCTT<br>GATAAACGCCGGGGGAGAGACCCGGAAATGGGGGGTAAACCC<br>CGAAGAAAGAATCCCCAAGAAGGACTCTACAATGAACTCCAG<br>AAGGATAAGATGGCGGAGGCCTACTCAGAAATAGGTATGAAG<br>GGCGAACGACGACGGGGAAAAGGTCACGATGGCCTCTACCAA<br>GGGTTGAGTACGGCAACCAAAGATACGTACGATGCACTGCATA<br>TGCAGGCCCTGCCTCCCAGATAATAATAAAATCGCTATCCATC<br>GAAGATGGATGTGTGTTGGTTTTTTGTGTGTGGAGCAACAAATC<br>TGACTTTGCATGTGCAAACGCCTTCAACAACAGCATTATTCCAG<br>AAGACACCTTCTTCCCCAGCCCAGGTAAGGGCAGCTTTGGTGC<br>CTTCGCAGGCTGTTTCCTTGCTTCAGGAATGGCCAGGTTCTGCC<br>CAGAGCTCTGGTCAATGATGTCTAAAACTCCTCTGATTGGTGGT<br>CTCGGCCTTATCCATTGCCACCAAAACCCTCTTTTTACTAAGAA<br>ACAGTGAGCCTTGTTCTGGCAGTCCAGAGAATGACACGGGAAA<br>AAAGCAGATGAAGAGAAGGTGGCAGGAGAGGGCACGTGGCCC<br>AGCCTCAGTCTCTCCAACTGAGTTCCTGCCTGCCTGCCTTTGCT<br>CAGACTGTTTGCCCCTTACTGCTCTTCTAGGCCTCATTCTAAGC<br>CCCTTCTCCAAGTTGCCTCTCCTTATTTCTCCCTGTCTGCCAAAA<br>AATCTTTCCCAGCTCACTAAGTCAGTCTCACGCAGTCACTCATT<br>AACCCACCAATCACTGATTGTGCCGGCACATGAATGCACCAGG<br>TGTTGAAGTGGAGGAATTAAAAAGTCAGATGAGGGGTGTGCCC<br>AGAGGAAGCACCATTCTAGTTGGGGGAGCCCATCTGTCAGCTG<br>GGAAAAGTCCAAATAACTTCAGATTGGAATGTGTTTTAACTCA<br>GGGTTGAGAAAACAGCTACCTTCAGGACAAAGTCAGGGAAG<br>GGCTCTCTGAAGAAATGCTACTTGAAGATACCAGCCCTACCAA<br>GGGCAGGGAGAGGACCCTATAGAGGCCTGGGACAGGAGCTCA<br>ATGAGAAAGG |
| 1420 | LHA to RHA of CTX-177 | GAGATGTAAGGAGCTGCTGTGACTTGCTCAAGGCCTTATATCG<br>AGTAAACGGTAGTGCTGGGGCTTAGACGCAGGTGTTCTGATTT<br>ATAGTTCAAAACCTCTATCAATGAGAGCAATCTCCTGGTAA<br>TGTGATAGATTTCCCAACTTAATGCCAACATACCATAAACCTCC<br>CATTCTGCTAATGCCCAGCCTAAGTTGGGGAGACCACTCCAGA<br>TTCCAAGATGTACAGTTTGCTTTGCTGGGCCTTTTTCCCATGCC |

TABLE 35-continued

Donor Template Nucleotide Sequences-Left Homology Arm to Right Homology Arm

| SEQ ID NO: | Description | Sequence |
|---|---|---|
| | | TGCCTTTACTCTGCCAGAGTTATATTGCTGGGGTTTTGAAGAAG<br>ATCCTATTAAATAAAAGAATAAGCAGTATTATTAAGTAGCCCT<br>GCATTTCAGGTTTCCTTGAGTGGCAGGCCAGGCCTGGCCGTGA<br>ACGTTCACTGAAATCATGGCCTCTTGGCCAAGATTGATAGCTTG<br>TGCCTGTCCCTGAGTCCCAGTCCATCACGAGCAGCTGGTTTCTA<br>AGATGCTATTTCCCGTATAAAGCATGAGACCGTGACTTGCCAG<br>CCCCACAGAGCCCCGCCCTTGTCCATCACTGGCATCTGGACTCC<br>AGCCTGGGTTGGGGCAAAGAGGGAAATGAGATCATGTCCTAAC<br>CCTGATCCTCTTGTCCCACAGATATCCAGAACCCTGACCCTGCC<br>GTGTACCAGCTGAGAGACTCTAAATCCAGTGACAAGTCTGTCT<br>GCCTATTCACCGATTTTGATTCTCAAACAAATGTGTCACAAAGT<br>AAGGATTCTGATGTGTATATCACAGACAAAACTGTGCTAGACA<br>TGAGGTCTATGGACTTCAGGCTCCGGTGCCCGTCAGTGGGCAG<br>AGCGCACATCGCCCACAGTCCCCGAGAAGTTGGGGGGAGGGG<br>TCGGCAATTGAACCGGTGCCTAGAGAAGGTGGCGCGGGGTAA<br>ACTGGGAAAGTGATGTCGTGTACTGGCTCCGCCTTTTTCCCGAG<br>GGTGGGGGAGAACCGTATATAAGTGCAGTAGTCGCCGTGAACG<br>TTCTTTTTCGCAACGGGTTTGCCGCCAGAACACAGGTAAGTGCC<br>GTGTGTGGTTCCCGCGGGCCTGGCCTCTTTACGGGTTATGGCCC<br>TTGCGTGCCTTGAATTACTTCCACTGGCTGCAGTACGTGATTCT<br>TGATCCCGAGCTTCGGGTTGGAAGTGGGTGGGAGAGTTCGAGG<br>CCTTGCGCTTAAGGAGCCCCTTCGCCTCGTGCTTGAGTTGAGGC<br>CTGGCCTGGGCGCTGGGGCCGCCGCGTGCGAATCTGGTGGCAC<br>CTTCGCGCCTGTCTCGCTGCTTTCGATAAGTCTCTAGCCATTTA<br>AAATTTTTGATGACCTGCTGCGACGCTTTTTTTCTGGCAAGATA<br>GTCTTGTAAATGCGGGCCAAGATCTGCACACTGGTATTTCGGTT<br>TTTGGGGCCGCGGGCGGCGACGGGGCCCGTGCGTCCCAGCGCA<br>CATGTTCGGCGAGGCGGGGCCTGCGAGCGCGGCCACCGAGAAT<br>CGGACGGGGGTAGTCTCAAGCTGGCCGGCCTGCTCTGGTGCCT<br>GGCCTCGCGCCGCCGTGTATCGCCCCGCCCTGGGCGGCAAGGC<br>TGGCCCGGTCGGCACCAGTTGCGTGAGCGGAAAGATGGCCGCT<br>TCCCGGCCCTGCTGCAGGGAGCTCAAAATGGAGGACGCGGCGC<br>TCGGGAGAGCGGGCGGGTGAGTCACCCACACAAAGGAAAAGG<br>GCCTTTCCGTCCTCAGCCGTCGCTTCATGTGACTCCACGGAGTA<br>CCGGGCGCCGTCCAGGCACCTCGATTAGTTCTCGAGCTTTTGGA<br>GTACGTCGTCTTTAGGTTGGGGGGAGGGGTTTTATGCGATGGA<br>GTTTCCCCACACTGAGTGGGTGGAGACTGAAGTTAGGCCAGCT<br>TGGCACTTGATGTAATTCTCCTTGGAATTTGCCCTTTTTGAGTTT<br>GGATCTTGGTTCATTCTCAAGCCTCAGACAGTGGTTCAAAGTTT<br>TTTTCTTCCATTTCAGGTGTCGTGACCACCATGGCGCTTCCGGT<br>GACAGCACTGCTCCTCCCCTTGGCGCTGTTGCTCCACGCAGCAA<br>GGCCGGATATCCAGATGACACAGAGCCCTAGCTCCCTGAGCGC<br>CAGCCTGGGCGATAGGGTGACCATCACCTGCAGGACCTCCCAG<br>GACATCAGCAACCACCTGAACTGGTACCAGCAGAAGCCCGGCA<br>AAGCCCCCAAGCTGCTGATCTACTACACCAGCAGGCTGGAAAG<br>CGGCGTGCCCAGCAGGTTTAGCGGAAGCGGCAGCGGCACCGA<br>CTACAGCCTGACCATCAGCTCCCTGCAGCCCGAGGACATCGGC<br>ACCTACTACTGCCAGCAGGGCAACACCCTGCCTCCCACCTTCG<br>GAGGCGGAACCAAGCTGGAGATTAAGGGAGGCGGCGGAAGCG<br>GCGGCGGCGGCTCCGGCGGAGGAGGCAGCCAGGTGCAGCTGG<br>TGCAGTCCGGAGCCGAGCTGAAAAAGCCTGGCGCCAGCGTGA<br>AGATCAGCTGCAAGGCCAGCGGCTACACCTTCACCGAGTACAC<br>CATCAACTGGGTGAGGCAGGCCCCTGGCCAGAGACTCGAGTGG<br>ATGGGCGACATCTACCCCGACAACTACTCCATCAGGTACAACC<br>AGAAGTTTCAGGGCAGGGTGACCATTACCAGGGACACCAGCGC<br>CAGCACAGCCTACATGGAGCTGAGCAGCCTGAGGAGCGAGGA<br>TACAGCCGTCTACTACTGCGCCAACCACGACTTTTTCGTGTTCT<br>GGGGACAGGGCACCCTGGTGACCGTGTCCTCCAGTGCTGCTGC<br>CTTTGTCCCGGTATTTCTCCCAGCCAAACCGACCACGACTCCCG<br>CCCCGCGCCCTCCGACACCCGCTCCCACCATCGCCTCTCAACCT<br>CTTAGTCTTCGCCCCGAGGCATGCCGACCCGCCGCCGGGGGTG<br>CTGTTCATACGAGGGGCTTGGACTTCGCTTGTGATATTTACATT<br>TGGGCTCCGTTGGCGGGTACGTGCGGCGTCCTTTTGTTGTCACT<br>CGTTATTACTTTGTATTGTAATCACAGGAATCGCTCAAAGCGGA<br>GTAGGTTGTTGCATTCCGATTACATGAATATGACTCCTCGCCGG<br>CCTGGGCCGACAAGAAAACATTACCAACCCTATGCCCCCCCAC<br>GAGACTTCGCTGCGTACAGGTCCCGAGTGAAGTTTTCCCGAAG<br>CGCAGACGCTCCGGCATATCAGCAAGGACAGAATCAGCTGTAT<br>AACGAACTGAATTTGGGACGCCGCGAGGAGTATGACGTGCTTG<br>ATAAACGCCGGGGAGAGACCCGAAATGGGGGTAAACCCC<br>GAAGAAAGAATCCCCAAGAAGGACTCTACAATGAACTCCAGA<br>AGGATAAGATGGCGGAGGCCTACTCAGAAATAGGTATGAAGG<br>GCGAACGACGACGGGGAAAAGGTCACGATGGCCTCTACCAAG<br>GGTTGAGTACGGCAACCAAAGATACGTACGATGCACTGCATAT<br>GCAGGCCCTGCCTCCCAGATAATAATAAAATCGCTATCCATCG |

TABLE 35-continued

Donor Template Nucleotide Sequences-Left Homology Arm to Right Homology Arm

| SEQ ID NO: | Description | Sequence |
|---|---|---|
| | | AAGATGGATGTGTGTTGGTTTTTTGTGTGTGGAGCAACAAATCT
GACTTTGCATGTGCAAACGCCTTCAACAACAGCATTATTCCAG
AAGACACCTTCTTCCCCAGCCCAGGTAAGGGCAGCTTTGGTGC
CTTCGCAGGCTGTTTCCTTGCTTCAGGAATGGCCAGGTTCTGCC
CAGAGCTCTGGTCAATGATGTCTAAAACTCCTCTGATTGGTGGT
CTCGGCCTTATCCATTGCCACCAAAACCCTCTTTTTACTAAGAA
ACAGTGAGCCTTGTTCTGGCAGTCCAGAGAATGACACGGGAAA
AAAGCAGATGAAGAAGGTGGCAGGAGAGGGCACGTGGCCC
AGCCTCAGTCTCTCCAACTGAGTTCCTGCCTGCCTGCCTTTGCT
CAGACTGTTTGCCCCTTACTGCTCTTCTAGGCCTCATTCTAAGC
CCCTTCTCCAAGTTGCCTCTCCTTATTTCTCCCTGTCTGCCAAAA
AATCTTTCCCAGCTCACTAAGTCAGTCTCACGCAGTCACTCATT
AACCCACCAATCACTGATTGTGCCGGCACATGAATGCACCAGG
TGTTGAAGTGGAGGAATTAAAAAGTCAGATGAGGGGTGTGCCC
AGAGGAAGCACCATTCTAGTTGGGGGAGCCCATCTGTCAGCTG
GGAAAAGTCCAAATAACTTCAGATTGGAATGTGTTTTAACTCA
GGGTTGAGAAAACAGCTACCTTCAGGACAAAAGTCAGGGAAG
GGCTCTCTGAAGAAATGCTACTTGAAGATACCAGCCCTACCAA
GGGCAGGGAGAGGACCCTATAGAGGCCTGGGACAGGAGCTCA
ATGAGAAAGG |
| 1421 | LHA to RHA of CTX-178 | GAGATGTAAGGAGCTGCTGTGACTTGCTCAAGGCCTTATATCG
AGTAAACGGTAGTGCTGGGGCTTAGACGCAGGTGTTCTGATTT
ATAGTTCAAAACCTCTATCAATGAGAGAGCAATCTCCTGGTAA
TGTGATAGATTTCCCAACTTAATGCCAACATACCATAAACCTCC
CATTCTGCTAATGCCCAGCCTAAGTTGGGGAGACCACTCCAGA
TTCCAAGATGTACAGTTTGCTTTGCTGGGCCTTTTTCCCATGCC
TGCCTTTACTCTGCCAGAGTTATATTGCTGGGGTTTTGAAGAAG
ATCCTATTAAATAAAAGAATAAGCAGTATTATTAAGTAGCCCT
GCATTTCAGGTTTCCTTGAGTGGCAGGCCAGGCCTGGCCGTGA
ACGTTCACTGAAATCATGGCCTCTTGGCCAAGATTGATAGCTTG
TGCCTGTCCCTGAGTCCCAGTCCATCACGAGCAGCTGGTTTCTA
AGATGCTATTTCCCGTATAAAGCATGAGACCGTGACTTGCCAG
CCCCACAGAGCCCCGCCCTTGTCCATCACTGGCATCTGGACTCC
AGCCTGGGTTGGGCAAAGAGGGAAATGAGATCATGTCCTAAC
CCTGATCCTCTTGTCCCACAGATATCCAGAACCCTGACCCTGCC
GTGTACCAGCTGAGAGACTCTAAATCAGTGACAAGTCTGTCT
GCCTATTCACCGATTTTGATTCTCAAACAAATGTGTCACAAAGT
AAGGATTCTGATGTGTATATCACAGACAAAACTGTGCTAGACA
TGAGGTCTATGGACTTCAGGCTCCGGTGCCCGTCAGTGGGCAG
AGCGCACATCGCCCACAGTCCCCGAGAAGTTGGGGGGAGGGG
TCGGCAATTGAACCGGTGCCTAGAGAAGGTGGCGCGGGGTAA
ACTGGGAAAGTGATGTCGTGTACTGGCTCCGCCTTTTTCCCGAG
GGTGGGGGAGAACCGTATATAAGTGCAGTAGTCGCCGTGAACG
TTCTTTTTCGCAACGGGTTTGCCGCCAGAACACAGGTAAGTGCC
GTGTGTGGTTCCCGCGGGCCTGGCCTCTTTACGGGTTATGGCCC
TTGCGTGCCTTGAATTACTTCCACTGGCTGCAGTACGTGATTCT
TGATCCCGAGCTTCGGGTTGGAAGTGGGTGGGAGAGTTCGAGG
CCTTGCGCTTAAGGAGCCCCTTCGCCTCGTGCTTGAGTTGAGGC
CTGGCCTGGGCGCTGGGGCCGCCGCGTGCGAATCTGGTGGCAC
CTTCGCGCCTGTCTCGCTGCTTTCGATAAGTCTCTAGCCATTTA
AAATTTTTGATGACCTGCTGCGACGCTTTTTTTCTGGCAAGATA
GTCTTGTAAATGCGGGCCAAGATCTGCACACTGGTATTTCGGTT
TTTGGGGCCGCGGGCGGCGACGGGGCCCGTGCGTCCCAGCGCA
CATGTTCGGCGAGGCGGGGCCTGCGAGCGCGGCCACCGAGAAT
CGGACGGGGGTAGTCTCAAGCTGGCCGGCCTGCTCTGGTGCCT
GGCCTCGCGCCGCCGTGTATCGCCCCGCCCTGGGCGGCAAGGC
TGGCCCCGGTCGGCACCAGTTGCGTGAGCGGAAAGATGGCCGCT
TCCCGGCCCTGCTGCAGGGAGCTCAAAATGGAGGACGCGGCGC
TCGGGAGAGCGGGCGGGTGAGTCACCCACACAAAGGAAAAGG
GCCTTTCCGTCCTCAGCCGTCGCTTCATGTGACTCCACGGAGTA
CCGGGCGCCGTCCAGGCACCTCGATTAGTTCTCGAGCTTTTGGA
GTACGTCGTCTTTAGGTTGGGGGAGGGGTTTTATGCGATGGA
GTTTCCCCACACTGAGTGGGTGGAGACTGAAGTTAGGCCAGCT
TGGCACTTGATGTAATTCTCCTTGGAATTTGCCCTTTTTGAGTTT
GGATCTTGGTTCATTCTCAAGCCTCAGACAGTGGTTCAAAGTTT
TTTTCTTCCATTTCAGGTGTCGTGACCACCATGGCGCTTCCGGT
GACAGCACTGCTCCTCCCCTTGGCGCTGTTGCTCCACGCAGCAA
GGCCGGACATCCAAATGACCCAGAGCCCTAGCTCCCTGAGCGC
TTCCGTGGGCGACAGAGTGACCATTACCTGCCAGGCCAGCCAG
GACATCAGCAACTACCTGAACTGGTATCAGCAGAAGCCTGGCA
AGGCCCCCAAGCTGCTGATCTACTACACCAGCAGGCTGGAGAC
CGGAGTGCCCAGCAGGTTTAGCGGCTCCGGATCCGGCACCGAC
TTCACCTTCACCATCTCCAGCCTGCAGCCCGAGGACATCGCCAC
CTACTACTGCCAGCAGGGCAATACCCTCCCCCCTACCTTCGGA |

TABLE 35-continued

Donor Template Nucleotide Sequences-Left Homology Arm to Right Homology Arm

| SEQ ID NO: | Description | Sequence |
|---|---|---|
| | | GGCGGCACCAAGGTGGAGATCAAGGGCGGCGGCGGCTCCGGC
GGCGGCGGCAGCGGCGGAGGCGGCAGCCAGGTGCAACTGGTG
CAGAGCGGCCCTGAGCTGAAGAAACCCGGCGCCAGCGTGAAA
ATCAGCTGCAAGACCAGCGGCTACACATTCACCGAGTACACCA
TCAACTGGGTGAAGCAGGCTCCCGGACAGGGACTGGAGTGGAT
CGGCGACATCTACCCTGACAACTACAACATCAGATACAACCAA
AAGTTCCAGGGCAAGGCCACCATCACCAGGGACACCAGCTCCT
CCACCGCCTACATGGAGCTGAGCAGCCTGAGGAGCGAGGACA
CCGCTGTGTACTACTGCGCCAACCACGACTTCTTCGTGTTCTGG
GGCCAGGGAACCCTGGTGACCGTGAGCAGCAGTGCTGCTGCCT
TTGTCCCGGTATTTCTCCCAGCCAAACCGACCACGACTCCCGCC
CCGCGCCCTCCGACACCCGCTCCCACCATCGCCTCTCAACCTCT
TAGTCTTCGCCCCGAGGCATGCCGACCCGCCGCCGGGGGTGCT
GTTCATACGAGGGGCTTGGACTTCGCTTGTGATATTTACATTTG
GGCTCCGTTGGCGGGTACGTGCGGCGTCCTTTTGTTGTCACTCG
TTATTACTTTGTATTGTAATCACAGGAATCGCTCAAAGCGGAGT
AGGTTGTTGCATTCCGATTACATGAATATGACTCCTCGCCGGCC
TGGGCCGACAAGAAAACATTACCAACCCTATGCCCCCCCACGA
GACTTCGCTGCGTACAGGTCCCGAGTGAAGTTTTCCCGAAGCG
CAGACGCTCCGGCATATCAGCAAGGACAGAATCAGCTGTATAA
CGAACTGAATTTGGGACGCCGCGAGGAGTATGACGTGCTTGAT
AAACGCCGGGGAGAGACCCGGAAATGGGGGTAAACCCCGA
AGAAAGAATCCCCAAGAAGGACTCTACAATGAACTCCAGAAG
GATAAGATGGCGGAGGCCTACTCAGAAATAGGTATGAAGGGC
GAACGACGACGGGGAAAAGGTCACGATGGCCTCTACCAAGGG
TTGAGTACGGCAACCAAAGATACGTACGATGCACTGCATATGC
AGGCCCTGCCTCCCAGATAATAATAAAATCGCTATCCATCGAA
GATGGATGTGTGTTGGTTTTTTGTGTGTGGAGCAACAAATCTGA
CTTTGCATGTGCAAACGCCTTCAACAACAGCATTATTCCAGAA
GACACCTTCTTCCCCAGCCCAGGTAAGGGCAGCTTTGGTGCCTT
CGCAGGCTGTTTCCTTGCTTCAGGAATGGCCAGGTTCTGCCCAG
AGCTCTGGTCAATGATGTCTAAAACTCCTCTGATTGGTGGTCTC
GGCCTTATCCATTGCCACCAAAACCCTCTTTTTACTAAGAAACA
GTGAGCCTTGTTCTGGCAGTCCAGAGAATGACACGGGAAAAAA
GCAGATGAAGAGAAGGTGGCAGGAGAGGGCACGTGGCCCAGC
CTCAGTCTCTCCAACTGAGTTCCTGCCTGCCTGCCTTTGCTCAG
ACTGTTTGCCCCTTACTGCTCTTCTAGGCCTCATTCTAAGCCCCT
TCTCCAAGTTGCCTCTCCTTATTTCTCCCTGTCTGCCAAAAAAT
CTTTCCCAGCTCACTAAGTCAGTCTCACGCAGTCACTCATTAAC
CCACCAATCACTGATTGTGCCGGCACATGAATGCACCAGGTGT
TGAAGTGGAGGAATTAAAAAGTCAGATGAGGGGTGTGCCCAG
AGGAAGCACCATTCTAGTTGGGGGAGCCCATCTGTCAGCTGGG
AAAAGTCCAAATAACTTCAGATTGGAATGTGTTTTAACTCAGG
GTTGAGAAAACAGCTACCTTCAGGACAAAAGTCAGGGAAGGG
CTCTCTGAAGAAATGCTACTTGAAGATACCAGCCCTACCAAGG
GCAGGGAGAGGACCCTATAGAGGCCTGGGACAGGAGCTCAAT
GAGAAAGG |
| 1422 | LHA to RHA of CTX-179 | GAGATGTAAGGAGCTGCTGTGACTTGCTCAAGGCCTTATATCG
AGTAAACGGTAGTGCTGGGGCTTAGACGCAGGTGTTCTGATTT
ATAGTTCAAAACCTCTATCAATGAGAGCAATCTCCTGGTAA
TGTGATAGATTTCCCAACTTAATGCCAACATACCATAAACCTCC
CATTCTGCTAATGCCCAGCCTAAGTTGGGGAGACCACTCCAGA
TTCCAAGATGTACAGTTTGCTTTGCTGGGCCTTTTTCCCATGCC
TGCCTTTACTCTGCCAGAGTTATATTGCTGGGGTTTTGAAGAAG
ATCCTATTAAATAAAAGAATAAGCAGTATTATTAAGTAGCCCT
GCATTTCAGGTTTCCTTGAGTGGCAGGCCAGGCCTGGCCGTGA
ACGTTCACTGAAATCATGGCCTCTTGGCCAAGATTGATAGCTTG
TGCCTGTCCCTGAGTCCCAGTCCATCACGAGCAGCTGGTTTCTA
AGATGCTATTTCCCGTATAAAGCATGAGACCGTGACTTGCCAG
CCCCACAGAGCCCCGCCCTTGTCCATCACTGGCATCTGGACTCC
AGCCTGGGTTGGGGCAAAGAGGGAAATGAGATCATGTCCTAAC
CCTGATCCTCTTGTCCCACAGATATCCAGAACCCTGACCCTGCC
GTGTACCAGCTGAGAGACTCTAAATCAGTGACAAGTCTGTCT
GCCTATTCACCGATTTTGATTCTCAAACAAATGTGTCACAAAGT
AAGGATTCTGATGTGTATATCACAGACAAAACTGTGCTAGACA
TGAGGTCTATGGACTTCAGGCTCCGGTGCCCGTCAGTGGGCAG
AGCGCACATCGCCCACAGTCCCCGAGAAGTTGGGGGAGGG
TCGGCAATTGAACCGGTGCCTAGAGAAGGTGGCGCGGGGTAA
ACTGGGAAAGTGATGTCGTGTACTGGCTCCGCCTTTTTCCCGAG
GGTGGGGGAGAACCGTATATAAGTGCAGTAGTCGCCGTGAACG
TTCTTTTTCGCAACGGGTTTGCCGCCAGAACACAGGTAAGTGCC
GTGTGTGGTTCCCGCGGGCCTGGCCTCTTTACGGGTTATGGCCC
TTGCGTGCCTTGAATTACTTCCACTGGCTGCAGTACGTGATTCT
TGATCCCGAGCTTCGGGTTGGAAGTGGGTGGGAGAGTTCGAGG |

TABLE 35-continued

Donor Template Nucleotide Sequences-Left Homology Arm to Right Homology Arm

| SEQ ID NO: | Description | Sequence |
|---|---|---|
| | | CCTTGCGCTTAAGGAGCCCCTTCGCCTCGTGCTTGAGTTGAGGC
CTGGCCTGGGCGCTGGGGCCGCCGCGTGCGAATCTGGTGGCAC
CTTCGCGCCTGTCTCGCTGCTTTCGATAAGTCTCTAGCCATTTA
AAATTTTTGATGACCTGCTGCGACGCTTTTTTTCTGGCAAGATA
GTCTTGTAAATGCGGGCCAAGATCTGCACACTGGTATTTCGGTT
TTTGGGGCCGCGGGCGGCGACGGGGCCCGTGCGTCCCAGCGCA
CATGTTCGGCGAGGCGGGGCCTGCGAGCGCGGCCACCGAGAAT
CGGACGGGGGTAGTCTCAAGCTGGCCGGCCTGCTCTGGTGCCT
GGCCTCGCGCCGCCGTGTATCGCCCCGCCCTGGGCGGCAAGGC
TGGCCCGGTCGGCACCAGTTGCGTGAGCGGAAAGATGGCCGCT
TCCCGGCCCTGCTGCAGGGAGCTCAAAATGGAGGACGCGGCGC
TCGGGAGAGCGGGCGGGTGAGTCACCCACACAAAGGAAAAGG
GCCTTTCCGTCCTCAGCCGTCGCTTCATGTGACTCCACGGAGTA
CCGGGCGCCGTCCAGGCACCTCGATTAGTTCTCGAGCTTTTGGA
GTACGTCGTCTTTAGGTTGGGGGGAGGGGTTTTATGCGATGGA
GTTTCCCCACACTGAGTGGGTGGAGACTGAAGTTAGGCCAGCT
TGGCACTTGATGTAATTCTCCTTGGAATTTGCCCTTTTTGAGTTT
GGATCTTGGTTCATTCTCAAGCCTCAGACAGTGGTTCAAAGTTT
TTTTCTTCCATTTCAGGTGTCGTGACCACCATGGCGCTTCCGGT
GACAGCACTGCTCCTCCCCTTGGCGCTGTTGCTCCACGCAGCAA
GGCCGGATATCCAGATGACACAAAGCCCCAGCAGCCTGTCCGC
TAGCCTGGGCGATAGGGTGACCATCACATGCAGGACCAGCCAG
GACATCTCCAACCACCTGAACTGGTACCAGCAGAAGCCTGGAA
AGGCCCCCAAACTGCTGATCTACTACACCAGCAGGCTGGAGAG
CGGCGTGCCTAGCAGGTTTTCCGGCAGCGGCAGCGGCACCGAC
TATAGCCTGACCATCAGCTCCCTGCAGCCCGAGGACATCGGCA
CCTACTACTGCCAGCAGGGAAACACACTGCCCCCCACCTTTGG
CGGCGGCACAAAGCTGGAGATCAAGGGCGGCGGCGGATCCGG
CGGCGGAGGCAGCGGAGGAGGAGGAAGCCAGGTGCAGCTGGT
GCAGTCCGGCCCTGAGCTGAAGAAGCCCGGAGCCAGCGTGAA
AATTAGCTGCAAGACCTCCGGCTACACATTCACCGAGTACACC
ATCAACTGGGTGAAGCAGGCTCCCGGCCAGGGACTGGAGTGG
ATCGGCGACATCTACCCCGACAACTACAACATCAGGTACAACC
AGAAATTCCAGGGCAAGGCCACCATCACCAGGGACACCAGCTC
CTCCACCGCCTATATGGAGCTGTCCAGCCTGAGAAGCGAGGAT
ACCGCCGTGTACTACTGCGCCAACCACGATTTCTTCGTGTTCTG
GGGCCAGGGCACACTGGTCACCGTGAGCAGCAGTGCTGCTGCC
TTTGTCCCGGTATTTCTCCCAGCCAAACCGACCACGACTCCCGC
CCCGCGCCCTCCGACACCCGCTCCCACCATCGCCTCTCAACCTC
TTAGTCTTCGCCCCGAGGCATGCCGACCCGCCGCCGGGGGTGC
TGTTCATACGAGGGGCTTGGACTTCGCTTGTGATATTTACATTT
GGGCTCCGTTGGCGGGTACGTGCGGCGTCCTTTTGTTGTCACTC
GTTATTACTTTGTATTGTAATCACAGGAATCGCTCAAAGCGGA
GTAGGTTGTTGCATTCCGATTACATGAATATGACTCCTCGCCGG
CCTGGGCCGACAAGAAAACATTACCAACCCTATGCCCCCCCAC
GAGACTTCGCTGCGTACAGGTCCCGAGTGAAGTTTTCCCGAAG
CGCAGACGCTCCGGCATATCAGCAAGGACAGAATCAGCTGTAT
AACGAACTGAATTTGGGACGCCGCGAGGAGTATGACGTGCTTG
ATAAACGCCGGGGAGAGACCCGGAAATGGGGGTAAACCCC
GAAGAAAGAATCCCCAAGAAGGACTCTACAATGAACTCCAGA
AGGATAAGATGGCGGAGGCCTACTCAGAAATAGGTATGAAGG
GCGAACGACGACGGGGAAAAGGTCACGATGGCCTCTACCAAG
GGTTGAGTACGGCAACCAAAGATACGTACGATGCACTGCATAT
GCAGGCCCTGCCTCCCAGATAATAATAAAATCGCTATCCATCG
AAGATGGATGTGTGTTGGTTTTTTGTGTGTGGAGCAACAAATCT
GACTTTGCATGTGCAAACGCCTTCAACAACAGCATTATTCCAG
AAGACACCTTCTTCCCCAGCCAGGTAAGGGCAGCTTTGGTGC
CTTCGCAGGCTGTTTCCTTGCTTCAGGAATGGCCAGGTTCTGCC
CAGAGCTCTGGTCAATGATGTCTAAAACTCCTCTGATTGGTGGT
CTCGGCCTTATCCATTGCCACCAAAACCCTCTTTTTACTAAGAA
ACAGTGAGCCTTGTTCTGGCAGTCCAGAGAATGACACGGGAAA
AAAGCAGATGAAGAGAAGGTGGCAGGAGAGGGCACGTGGCCC
AGCCTCAGTCTCTCCAACTGAGTTCCTGCCTGCCTGCCTTTGCT
CAGACTGTTTGCCCCTTACTGCTCTTCTAGGCCTCATTCTAAGC
CCCTTCTCCAAGTTGCCTCTCCTTATTTCTCCCTGTCTGCCAAAA
AATCTTTCCCAGCTCACTAAGTCAGTCTCACGCAGTCACTCATT
AACCCACCAATCACTGATTGTGCCGGCACATGAATGCACCAGG
TGTTGAAGTGGAGGAATTAAAAAGTCAGATGAGGGGTGTGCCC
AGAGGAAGCACCATTCTAGTTGGGGGAGCCCATCTGTCAGCTG
GGAAAAGTCCAAATAACTTCAGATTGGAATGTGTTTTAACTCA
GGGTTGAGAAAACAGCTACCTTCAGGACAAAAGTCAGGGAAG
GGCTCTCTGAAGAAATGCTACTTGAAGATACCAGCCCTACCAA
GGGCAGGGAGAGGACCCTATAGAGGCCTGGGACAGGAGCTCA
ATGAGAAAGG |

TABLE 36

CAR Nucleotide Sequences

| SEQ ID NO: | Description | Sequence |
|---|---|---|
| 1316 | Anti-CD19 CAR of CTX-131 to CTX 141 | ATGCTTCTTTTGGTTACGTCTCTGTTGCTTTGCGAACTTCCTCAT CCAGCGTTCTTGCTGATCCCGATATTCAGATGACTCAGACCAC CAGTAGCTTGTCTGCCTCACTGGGAGACCGAGTAACAATCTCC TGCAGGGCAAGTCAAGACATTAGCAAATACCTCAATTGGTACC AGCAGAAGCCCGACGGAACGGTAAAACTCCTCATCTATCATAC GTCAAGGTTGCATTCCGGAGTACCGTCACGATTTTCAGGTTCTG GGAGCGGAACTGACTATTCCTTGACTATTTCAAACCTCGAGCA GGAGGACATTGCGACATATTTTTGTCAACAAGGTAATACCCTC CCTTACACTTTCGGAGGAGGAACCAAACTCGAAATTACCGGGT CCACCAGTGGCTCTGGGAAGCCTGGCAGTGGAGAAGGTTCCAC TAAAGGCGAGGTGAAGCTCCAGGAGAGCGGCCCCGGTCTCGTT GCCCCCAGTCAAAGCCTCTCTGTAACGTGCACAGTGAGTGGTG TATCATTGCCTGATTATGGCGTCTCCTGGATAAGGCAGCCCCCG CGAAAGGGTCTTGAATGGCTTGGGGTAATATGGGGCTCAGAGA CAACGTATTATAACTCCGCTCTCAAAAGTCGCTTGACGATAAT AAAAGATAACTCCAAGAGTCAAGTTTTCCTTAAATGAACAGT TTGCAGACTGACGATACCGCTATATATTATTGTGCTAAACATTA TTACTACGGCGGTAGTTACGCGATGGATTATTGGGGCAGGGG ACTTCTGTCACAGTCAGTAGTGCTGCTGCCTTTGTCCCGGTATT TCTCCCAGCCAAACCGACCACGACTCCCGCCCCGCGCCCTCCG ACACCCGCTCCCACCATCGCCTCTCAACCTCTTAGTCTTCGCCC CGAGGCATGCCGACCCGCCGCCGGGGGTGCTGTTCATACGAGG GGCTTGGACTTCGCTTGTGATATTTACATTTGGGCTCCGTTGGC GGGTACGTGCGGCGTCCTTTTGTTGTCACTCGTTATTACTTTGT ATTGTAATCACAGGAATCGCTCAAAGCGGAGTAGGTTGTTGCA TTCCGATTACATGAATATGACTCCTCGCCGGCCTGGGCCGACA AGAAAACATTACCAACCCTATGCCCCCCACGAGACTTCGCTG CGTACAGGTCCCGAGTGAAGTTTTCCCGAAGCGCAGACGCTCC GGCATATCAGCAAGGACAGAATCAGCTGTATAACGAACTGAAT TTGGGACGCCGCGAGGAGTATGACGTGCTTGATAAACGCCGGG GGAGAGACCCGGAAATGGGGGGTAAACCCCGAAGAAAGAATC CCCAAGAAGGACTCTACAATGAACTCCAGAAGGATAAGATGG CGGAGGCCTACTCAGAAATAGGTATGAAGGGCGAACGACGAC GGGGAAAAGGTCACGATGGCCTCTACCAAGGGTTGAGTACGGC AACCAAAGATACGTACGATGCACTGCATATGCAGGCCCTGCCT CCCAGA |
| 1423 | Anti-CD70A CAR of CTX-142 | ATGGCGCTTCCGGTGACAGCACTGCTCCTCCCCTTGGCGCTGTT GCTCCACGCAGCAAGGCCGGATATAGTTATGACCCAATCACCC GATAGTCTTGCGGTAAGCCTGGGGGAGCGAGCAACAATAAACT GTCGGGCATCAAAATCCGTCAGTACAAGCGGGTATTCATTCAT GCACTGGTATCAACAGAAACCCGGTCAGCCACCCAAGCTCCTG ATTTATCTTGCGTCTAATCTTGAGTCCGGCGTCCCAGACCGGTT TTCCGGCTCCGGGAGCGGCACGGATTTTACTCTTACTATTTCTA GCCTTCAGGCCGAAGATGTGGCGGTATACTACTGCCAGCATTC AAGGGAAGTTCCTTGGACGTTCGGTCAGGGCACGAAAGTGGAA ATTAAAGGCGGGGGGGGATCCGGCGGGGGAGGGTCTGGAGGA GGTGGCAGTGGTCAGGTCCAACTGGTGCAGTCCGGGGCAGAGG TAAAAAAACCCGGCGCGTCTGTTAAGGTTTCATGCAAGGCCAG TGGATATACTTTCACCAATTACGGAATGAACTGGGTGAGGCAG GCCCCTGGTCAAGGCCTGAAATGGATGGGATGGATAAACACGT ACACCGGTGAACCTACCTATGCCGATGCCTTTAAGGGTCGGGT TACGATGACGAGAGACACCTCCATATCAACAGCCTACATGGAG CTCAGCAGATTGAGGAGTGACGATACGGCAGTCTATTACTGTG CAAGAGACTACGGCGATTATGGCATGGATTACTGGGGCCAGGG CACTACAGTAACCGTTTCCAGCAGTGCTGCTGCCTTTGTCCCGG TATTTCTCCCAGCCAAACCGACCACGACTCCCGCCCCGCGCCCT CCGACACCCGCTCCCACCATCGCCTCTCAACCTCTTAGTCTTCG CCCCGAGGCATGCCGACCCGCCGCCGGGGGTGCTGTTCATACG AGGGGCTTGGACTTCGCTTGTGATATTTACATTTGGGCTCCGTT GGCGGGTACGTGCGGCGTCCTTTTGTTGTCACTCGTTATTACTT TGTATTGTAATCACAGGAATCGCTCAAAGCGGAGTAGGTTGTT GCATTCCGATTACATGAATATGACTCCTCGCCGGCCTGGGCCG ACAAGAAAACATTACCAACCCTATGCCCCCCACGAGACTTCG CTGCGTACAGGTCCCGAGTGAAGTTTTCCCGAAGCGCAGACGC TCCGGCATATCAGCAAGGACAGAATCAGCTGTATAACGAACTG AATTTGGGACGCCGCGAGGAGTATGACGTGCTTGATAAACGCC GGGGGAGAGACCCGGAAATGGGGGGTAAACCCCGAAGAAAGA ATCCCCAAGAAGGACTCTACAATGAACTCCAGAAGGATAAGAT GGCGGAGGCCTACTCAGAAATAGGTATGAAGGGCGAACGACG ACGGGGAAAAGGTCACGATGGCCTCTACCAAGGGTTGAGTACG GCAACCAAAGATACGTACGATGCACTGCATATGCAGGCCCTGC CTCCCAGA |

TABLE 36-continued

CAR Nucleotide Sequences

| SEQ ID NO: | Description | Sequence |
| --- | --- | --- |
| 1424 | Anti-CD70B CAR of CTX-145 | ATGGCGCTTCCGGTGACAGCACTGCTCCTCCCCTTGGCGCTGTT<br>GCTCCACGCAGCAAGGCCGCAGGTCCAGTTGGTGCAAAGCGGG<br>GCGGAGGTGAAAAAACCCGGCGCTTCCGTGAAGGTGTCCTGTA<br>AGGCGTCCGGTTATACGTTCACGAACTACGGGATGAATTGGGT<br>TCGCCAAGCGCCGGGGCAGGGACTGAAATGGATGGGGTGGAT<br>AAATACCTACACCGGCGAACCTACATACGCCGACGCTTTTAAA<br>GGGCGAGTCACTATGACGCGCGATACCAGCATATCCACCGCAT<br>ACATGGAGCTGTCCCGACTCCGGTCAGACGACACGGCTGTCTA<br>CTATTGTGCTCGGGACTATGGCGATTATGGCATGGACTACTGG<br>GGTCAGGGTACGACTGTAACAGTTAGTAGTGGTGGAGGCGGCA<br>GTGGCGGGGGGGAAGCGGAGGAGGGGGTTCTGGTGACATAG<br>TTATGACCCAATCCCCAGATAGTTTGGCGGTTTCTCTGGGCGAG<br>AGGGCAACGATTAATTGTCGCGCATCAAAGAGCGTTTCAACGA<br>GCGGATATTCTTTTATGCATTGGTACCAGCAAAAACCCGGACA<br>ACCGCCGAAGCTGCTGATCTACTTGGCTTCAAATCTTGAGTCTG<br>GGGTGCCGGACCGATTTTCTGGTAGTGGAAGCGGAACTGACTT<br>TACGCTCACGATCAGTTCACTGCAGGCTGAGGATGTAGCGGTC<br>TATTATTGCCAGCACAGTAGAGAAGTCCCCTGGACCTTCGGTC<br>AAGGCACGAAAGTAGAAATTAAAAGTGCTGCTGCCTTTGTCCC<br>GGTATTTCTCCCAGCCAAACCGACCACGACTCCCGCCCCGCGC<br>CCTCCGACACCCGCTCCCACCATCGCCTCTCAACCTCTTAGTCT<br>TCGCCCCGAGGCATGCCGACCCGCCGCCGGGGGTGCTGTTCAT<br>ACGAGGGGCTTGGACTTCGCTTGTGATATTTACATTTGGGCTCC<br>GTTGGCGGGTACGTGCGGCGTCCTTTTGTTGTCACTCGTTATTA<br>CTTTGTATTGTAATCACAGGAATCGCTCAAAGCGGAGTAGGTT<br>GTTGCATTCCGATTACATGAATATGACTCCTCGCCGGCCTGGGC<br>CGACAAGAAAACATTACCAACCCTATGCCCCCCACGAGACTT<br>CGCTGCGTACAGGTCCCGAGTGAAGTTTTCCCGAAGCGCAGAC<br>GCTCCGGCATATCAGCAAGGACAGAATCAGCTGTATAACGAAC<br>TGAATTTGGGACGCCGCGAGGAGTATGACGTGCTTGATAAACG<br>CCGGGGGAGAGACCCGGAAATGGGGGGTAAACCCCGAAGAAA<br>GAATCCCCAAGAAGGACTCTACAATGAACTCCAGAAGGATAA<br>GATGGCGGAGGCCTACTCAGAAATAGGTATGAAGGGCGAACG<br>ACGACGGGGAAAAGGTCACGATGGCCTCTACCAAGGGTTGAGT<br>ACGGCAACCAAAGATACGTACGATGCACTGCATATGCAGGCCC<br>TGCCTCCCAGA |
| 1275 | Anti-CD70 CAR of CTX-145b | ATGGCGCTTCCGGTGACAGCACTGCTCCTCCCCTTGGCGCTGTT<br>GCTCCACGCAGCAAGGCCGCAGGTCCAGTTGGTGCAAAGCGGG<br>GCGGAGGTGAAAAAACCCGGCGCTTCCGTGAAGGTGTCCTGTA<br>AGGCGTCCGGTTATACGTTCACGAACTACGGGATGAATTGGGT<br>TCGCCAAGCGCCGGGGCAGGGACTGAAATGGATGGGGTGGAT<br>AAATACCTACACCGGCGAACCTACATACGCCGACGCTTTTAAA<br>GGGCGAGTCACTATGACGCGCGATACCAGCATATCCACCGCAT<br>ACATGGAGCTGTCCCGACTCCGGTCAGACGACACGGCTGTCTA<br>CTATTGTGCTCGGGACTATGGCGATTATGGCATGGACTACTGG<br>GGTCAGGGTACGACTGTAACAGTTAGTAGTGGTGGAGGCGGCA<br>GTGGCGGGGGGGAAGCGGAGGAGGGGGTTCTGGTGACATAG<br>TTATGACCCAATCCCCAGATAGTTTGGCGGTTTCTCTGGGCGAG<br>AGGGCAACGATTAATTGTCGCGCATCAAAGAGCGTTTCAACGA<br>GCGGATATTCTTTTATGCATTGGTACCAGCAAAAACCCGGACA<br>ACCGCCGAAGCTGCTGATCTACTTGGCTTCAAATCTTGAGTCTG<br>GGGTGCCGGACCGATTTTCTGGTAGTGGAAGCGGAACTGACTT<br>TACGCTCACGATCAGTTCACTGCAGGCTGAGGATGTAGCGGTC<br>TATTATTGCCAGCACAGTAGAGAAGTCCCCTGGACCTTCGGTC<br>AAGGCACGAAAGTAGAAATTAAAAGTGCTGCTGCCTTTGTCCC<br>GGTATTTCTCCCAGCCAAACCGACCACGACTCCCGCCCCGCGC<br>CCTCCGACACCCGCTCCCACCATCGCCTCTCAACCTCTTAGTCT<br>TCGCCCCGAGGCATGCCGACCCGCCGCCGGGGGTGCTGTTCAT<br>ACGAGGGGCTTGGACTTCGCTTGTGATATTTACATTTGGGCTCC<br>GTTGGCGGGTACGTGCGGCGTCCTTTTGTTGTCACTCGTTATTA<br>CTTTGTATTGTAATCACAGGAATCGCTCAAACGGGGCAGAAAGAA<br>ACTCCTGTATATATTCAAACAACCATTTATGAGACCAGTACAA<br>ACTACTCAAGAGGAAGATGGCTGTAGCTGCCGATTTCCAGAAG<br>AAGAAGAGGAGGATGTGAACTGCGAGTGAAGTTTTCCCGAA<br>GCGCAGACGCTCCGGCATATCAGCAAGGACAGAATCAGCTGTA<br>TAACGAACTGAATTTGGGACGCCGCGAGGAGTATGACGTGCTT<br>GATAAACGCGGGGGAGAGACCCGGAAATGGGGGGTAAACCC<br>CGAAGAAAGAATCCCCAAGAAGGACTCTACAATGAACTCCAG<br>AAGGATAAGATGGCGGAGGCCTACTCAGAAATAGGTATGAAG<br>GGCGAACGACGACGGGGAAAAGGTCACGATGGCCTCTACCAA<br>GGGTTGAGTACGGCAACCAAAGATACGTACGATGCACTGCATA<br>TGCAGGCCCTGCCTCCCAGATAA |

TABLE 36-continued

CAR Nucleotide Sequences

| SEQ ID NO: | Description | Sequence |
| --- | --- | --- |
| 1425 | Anti-BCMA-1 CAR of CTX 152 and CTX-153 | ATGGCTCTTCCTGTAACCGCACTTCTGCTTCCTCTTGCTCTGCTG<br>CTTCATGCTGCTAGACCTCAGGTGCAGTTACAACAGTCAGGAG<br>GAGGATTAGTGCAGCCAGGAGGATCTCTGAAACTGTCTTGTGC<br>CGCCAGCGGAATCGATTTTAGCAGGTACTGGATGTCTTGGGTG<br>AGAAGAGCCCCTGGAAAAGGACTGGAGTGGATCGGCGAGATT<br>AATCCTGATAGCAGCACCATCAACTATGCCCCTAGCCTGAAGG<br>ACAAGTTCATCATCAGCCGGGACAATGCCAAGAACACCCTGTA<br>CCTGCAAATGAGCAAGGTGAGGAGCGAGGATACAGCTCTGTAC<br>TACTGTGCCAGCCTGTACTACGATTACGGAGATGCTATGGACT<br>ATTGGGGCCAGGGAACAAGCGTTACAGTGTCTTCTGGAGGAGG<br>AGGATCCGGTGGTGGTGTTCAGGAGGTGGAGGTTCGGGAGAT<br>ATTGTGATGACACAAAGCCAGCGGTTCATGACCACATCTGTGG<br>GCGACAGAGTGAGCGTGACCTGTAAAGCTTCTCAGTCTGTGGA<br>CAGCAATGTTGCCTGGTATCAGCAGAAGCCCAGACAGAGCCCT<br>AAAGCCCTGATCTTTTCTGCCAGCCTGAGATTTTCTGGCGTTCC<br>TGCCAGATTTACCGGCTCTGGCTCTGGCACCGATTTTACACTGA<br>CCATCAGCAATCTGCAGTCTGAGGATCTGGCCGAGTACTTTTGC<br>CAGCAGTACAACAACTACCCCCTGACCTTTGGAGCTGGCACAA<br>AACTGGAGCTGAAGAGTGCTGCTGCCTTTGTCCCGGTATTTCTC<br>CCAGCCAAACCGACCACGACTCCCGCCCCGCGCCCTCCGACAC<br>CCGCTCCCACCATCGCCTCTCAACCTCTTAGTCTTCGCCCCGAG<br>GCATGCCGACCCGCCGCGGGGGTGCTGTTCATACGAGGGGCT<br>TGGACTTCGCTTGTGATATTTACATTTGGGCTCCGTTGGCGGGT<br>ACGTGCGGCGTCCTTTTGTTGTCACTCGTTATTACTTTGTATTGT<br>AATCACAGGAATCGCTCAAAGCGGAGTAGGTTGTTGCATTCCG<br>ATTACATGAATATGACTCCTCGCCGGCCTGGGCCGACAAGAAA<br>ACATTACCAACCCTATGCCCCCCCACGAGACTTCGCTGCGTAC<br>AGGTCCCGAGTGAAGTTTTCCCGAAGCGCAGACGCTCCGGCAT<br>ATCAGCAAGGACAGAATCAGCTGTATAACGAACTGAATTTGGG<br>ACGCCGCGAGGAGTATGACGTGCTTGATAAACGCCGGGGAG<br>AGACCCGGAAATGGGGGGTAAACCCCGAAGAAAGAATCCCCA<br>AGAAGGACTCTACAATGAACTCCAGAAGGATAAGATGGCCGA<br>GGCCTACTCAGAAATAGGTATGAAGGGCGAACGACGACGGGG<br>AAAAGGTCACGATGGCCTCTACCAAGGGTTGAGTACGGCAACC<br>AAAGATACGTACGATGCACTGCATATGCAGGCCCTGCCTCCCA<br>GA |
| 1426 | Anti-BCMA-2 CAR of CTX-154 and CTX-155 | ATGGCTCTTCCTGTAACCGCACTTCTGCTTCCTCTTGCTCTGCTG<br>CTTCATGCTGCTAGACCTGACATCGTGATGACCCAAAGCCAGA<br>GGTTCATGACCACATCTGTGGGCGATAGAGTGAGCGTGACCTG<br>TAAAGCCTCTCAGTCTGTGGACAGCAATGTTGCCTGGTATCAG<br>CAGAAGCCTAGACAGAGCCCTAAAGCCCTGATCTTTAGCGCCA<br>GCCTGAGATTTAGCGGAGTTCCTGCCAGATTTACCGGAAGCGG<br>ATCTGGAACCGATTTTACACTGACCATCAGCAACCTGCAGAGC<br>GAGGATCTGGCCGAGTACTTTTGCCAGCAGTACAACAATTACC<br>CTCTGACCTTTGGAGCCGGCACAAAGCTGGAGCTGAAAGGAGG<br>AGGAGGATCTGGTGGTGGTGGTTCAGGAGGTGGAGGTTCGGGA<br>CAAGTTCAATTACAGCAATCTGGAGGAGGACTGGTTCAGCCTG<br>GAGGAAGCCTGAAGCTGTCTTGTGCCGCTTCTGGAATCGATTTT<br>AGCAGATACTGGATGAGCTGGGTGAGAAGAGCCCCTGGCAAA<br>GGACTGGAGTGGATTGGCGAGATTAATCCTGATAGCAGCACCA<br>TCAACTATGCCCCTAGCCTGAAGGACAAGTTCATCATCAGCCG<br>GGACAATGCCAAGAACACCCTGTACCTGCAAATGAGCAAGGTG<br>AGGAGCGAGGATACAGCTCTGTACTACTGTGCCAGCCTGTACT<br>ACGATTACGGAGATGCTATGGACTATTGGGGCCAGGGAACAAG<br>CGTTACAGTGAGCAGCAGTGCTGCTGCCTTTGTCCCGGTATTTC<br>TCCCAGCCAAACCGACCACGACTCCCGCCCCGCGCCCTCCGAC<br>ACCCGCTCCCACCATCGCCTCTCAACCTCTTAGTCTTCGCCCCG<br>AGGCATGCCGACCCGCCGCGGGGGTGCTGTTCATACGAGGGG<br>CTTGGACTTCGCTTGTGATATTTACATTTGGGCTCCGTTGGCGG<br>GTACGTGCGGCGTCCTTTTGTTGTCACTCGTTATTACTTTGTATT<br>GTAATCACAGGAATCGCTCAAAGCGGAGTAGGTTGTTGCATTC<br>CGATTACATGAATATGACTCCTCGCCGGCCTGGGCCGACAAGA<br>AAACATTACCAACCCTATGCCCCCCCACGAGACTTCGCTGCGT<br>ACAGGTCCCGAGTGAAGTTTTCCCGAAGCGCAGACGCTCCGGC<br>ATATCAGCAAGGACAGAATCAGCTGTATAACGAACTGAATTTG<br>GGACGCCGCGAGGAGTATGACGTGCTTGATAAACGCCGGGGG<br>AGAGACCCGGAAATGGGGGGTAAACCCCGAAGAAAGAATCCC<br>CAAGAAGGACTCTACAATGAACTCCAGAAGGATAAGATGGCG<br>GAGGCCTACTCAGAAATAGGTATGAAGGGCGAACGACGACGG<br>GGAAAAGGTCACGATGGCCTCTACCAAGGGTTGAGTACGGCAA<br>CCAAAGATACGTACGATGCACTGCATATGCAGGCCCTGCCTCC<br>CAGA |

TABLE 36-continued

CAR Nucleotide Sequences

| SEQ ID NO: | Description | Sequence |
| --- | --- | --- |
| 1427 | Anti-BCMA CAR of CTX-160 | ATGGCGCTTCCGGTGACAGCACTGCTCCTCCCCTTGGCGCTGTT GCTCCACGCAGCAAGGCCGGAGGTCCAGCTGGTGGAGAGCGG CGGAGGACTGGTCCAGCCTGGCGGCTCCCTGAAACTGAGCTGC GCCGCCAGCGGCATCGACTTCAGCAGGTACTGGATGAGCTGGG TGAGACAGGCCCCTGGCAAGGGCCTGGAATGGATCGGCGAGA TCAACCCCGACTCCAGCACCATCAACTACGCCGACAGCGTCAA GGGCAGGTTCACCATTAGCAGGGACAATGCCAAGAACACCCTG TACCTGCAGATGAACCTGAGCAGGGCCGAAGACACCGCCCTGT ACTACTGTGCCAGCCTGTACTACGACTATGGCGACGCTATGGA CTACTGGGGCCAGGGCACCCTGGTGACAGTGAGCTCCGGAGGA GGCGGCAGCGGCGGAGGCGGCAGCGGCGGAGGCGGCAGCGAC ATCCAGATGACCCAGAGCCCTAGCAGCCTGAGCGCCTCCGTGG GAGATAGGGTGACAATCACCTGTAGGGCCAGCCAGAGCGTGG ACTCCAACGTGGCCTGGTATCAACAGAAGCCCGAGAAGGCCCC CAAGAGCCTGATCTTTTCCGCCTCCCTGAGGTTCAGCGGAGTCC CCAGCAGGTTCTCCGGATCCGGCTCCGGAACCGACTTTACCCT GACCATCTCCAGCCTGCAGCCCGAGGACTTCGCCACCTACTAC TGCCAGCAGTACAACAGCTACCCCCTGACCTTCGGCGCCGGCA CAAAGCTGGAGATCAAGAGTGCTGCTGCCTTTGTCCCGGTATTT CTCCCAGCCAAACCGACCACGACTCCCGCCCCGCGCCCTCCGA CACCCGCTCCCACCATCGCCTCTCAACCTCTTAGTCTTCGCCCC GAGGCATGCCGACCCGCCGCCGGGGGTGCTGTTCATACGAGGG GCTTGGACTTCGCTTGTGATATTTACATTTGGGCTCCGTTGGCG GGTACGTGCGGCGTCCTTTTGTTGTCACTCGTTATTACTTTGTAT TGTAATCACAGGAATCGCTCAAAGCGGAGTAGGTTGTTGCATT CCGATTACATGAATATGACTCCTCGCCGGCCTGGGCCGACAAG AAAACATTACCAACCCTATGCCCCCCACGAGACTTCGCTGCG TACAGGTCCCGAGTGAAGTTTTCCCGAAGCGCAGACGCTCCGG CATATCAGCAAGGACAGAATCAGCTGTATAACGAACTGAATTT GGGACGCCGCGAGGAGTATGACGTGCTTGATAAACGCCGGGG GAGAGACCCGGAAATGGGGGGTAAACCCCGAAGAAAGAATCC CCAAGAAGGACTCTACAATGAACTCCAGAAGGATAAGATGGC GGAGGCCTACTCAGAAATAGGTATGAAGGGCGAACGACGACG GGGAAAAGGTCACGATGGCCTCTACCAAGGGTTGAGTACGGCA ACCAAAGATACGTACGATGCACTGCATATGCAGGCCCTGCCTC CCAGA |
| 1428 | Anti-BCMA CAR of CTX-160b | ATGGCGCTTCCGGTGACAGCACTGCTCCTCCCCTTGGCGCTGTT GCTCCACGCAGCAAGGCCGGAGGTCCAGCTGGTGGAGAGCGG CGGAGGACTGGTCCAGCCTGGCGGCTCCCTGAAACTGAGCTGC GCCGCCAGCGGCATCGACTTCAGCAGGTACTGGATGAGCTGGG TGAGACAGGCCCCTGGCAAGGGCCTGGAATGGATCGGCGAGA TCAACCCCGACTCCAGCACCATCAACTACGCCGACAGCGTCAA GGGCAGGTTCACCATTAGCAGGGACAATGCCAAGAACACCCTG TACCTGCAGATGAACCTGAGCAGGGCCGAAGACACCGCCCTGT ACTACTGTGCCAGCCTGTACTACGACTATGGCGACGCTATGGA CTACTGGGGCCAGGGCACCCTGGTGACAGTGAGCTCCGGAGGA GGCGGCAGCGGCGGAGGCGGCAGCGGCGGAGGCGGCAGCGAC ATCCAGATGACCCAGAGCCCTAGCAGCCTGAGCGCCTCCGTGG GAGATAGGGTGACAATCACCTGTAGGGCCAGCCAGAGCGTGG ACTCCAACGTGGCCTGGTATCAACAGAAGCCCGAGAAGGCCCC CAAGAGCCTGATCTTTTCCGCCTCCCTGAGGTTCAGCGGAGTCC CCAGCAGGTTCTCCGGATCCGGCTCCGGAACCGACTTTACCCT GACCATCTCCAGCCTGCAGCCCGAGGACTTCGCCACCTACTAC TGCCAGCAGTACAACAGCTACCCCCTGACCTTCGGCGCCGGCA CAAAGCTGGAGATCAAGAGTGCTGCTGCCTTTGTCCCGGTATTT CTCCCAGCCAAACCGACCACGACTCCCGCCCCGCGCCCTCCGA CACCCGCTCCCACCATCGCCTCTCAACCTCTTAGTCTTCGCCCC GAGGCATGCCGACCCGCCGCCGGGGGTGCTGTTCATACGAGGG GCTTGGACTTCGCTTGTGATATTTACATTTGGGCTCCGTTGGCG GGTACGTGCGGCGTCCTTTTGTTGTCACTCGTTATTACTTTGTAT TGTAATCACAGGAATCGCAAACGGGGCAGAAAGAAACTCCTGT ATATATTCAAACAACCATTTATGAGACCAGTACAAACTACTCA AGAGGAAGATGGCTGTAGCTGCCGATTTCCAGAAGAAGAAGA AGGAGGATGTGAACTGCGAGTGAAGTTTTCCCGAAGCGCAGAC GCTCCGGCATATCAGCAAGGACAGAATCAGCTGTATAACGAAC TGAATTTGGGACGCCGCGAGGAGTATGACGTGCTTGATAAACG CCGGGGGAGAGACCCGGAAATGGGGGGTAAACCCCGAAGAAA GAATCCCCAAGAAGGACTCTACAATGAACTCCAGAAGGATAA GATGGCGGAGGCCTACTCAGAAATAGGTATGAAGGGCGAACG ACGACGGGGAAAAGGTCACGATGGCCTCTACCAAGGGTTGAGT ACGGCAACCAAAGATACGTACGATGCACTGCATATGCAGGCC TGCCTCCCAGA |

TABLE 36-continued

CAR Nucleotide Sequences

| SEQ ID NO: | Description | Sequence |
|---|---|---|
| 1429 | Anti-BCMA CAR of CTX-161 | ATGGCGCTTCCGGTGACAGCACTGCTCCTCCCCTTGGCGCTGTT GCTCCACGCAGCAAGGCCGGAGGTGCAGCTGGTGGAGAGCGG AGGAGGACTGGTGCAGCCCGGAGGCTCCCTGAAGCTGAGCTGC GCTGCCTCCGGCATCGACTTCAGCAGGTACTGGATGAGCTGGG TGAGGCAGGCTCCCGGCAAAGGCCTGGAGTGGATCGGCGAGA TCAACCCCGACAGCAGCACCATCAACTACGCCGACAGCGTGAA GGGCAGGTTCACCATCAGCAGGGACAACGCCAAGAATACCCTG TACCTGCAGATGAACCTGAGCAGGGCCGAGGACACAGCCCTGT ACTACTGTGCCAGCCTGTACTACGACTATGGAGACGCTATGGA CTACTGGGGCCAGGGAACCCTGGTGACCGTGAGCAGCGGAGG CGGAGGCTCCGGCGGCGGAGGCAGCGGAGGAGGCGGCAGCGA TATCCAGATGACCCAGTCCCCCAGCTCCCTGAGCGCTAGCCCT GGCGACAGGGTGAGCGTGACATGCAAGGCCAGCCAGAGCGTG GACAGCAACGTGGCCTGGTACCAGCAGAAACCCAGACAGGCC CCCAAGGCCCTGATCTTCAGCGCCAGCCTGAGGTTTAGCGGCG TGCCCGCTAGGTTTACCGGATCCGGCAGCGGCACCGACTTCAC CCTGACCATCTCCAACCTGCAGTCCGAGGACTTCGCCACCTACT ACTGCCAGCAGTACAACAACTACCCCCTGACATTCGGCGCCGG AACCAAGCTGGAGATCAAGAGTGCTGCTGCCTTTGTCCCGGTA TTTCTCCCAGCCAAACCGACCACGACTCCCGCCCCGCGCCCTCC GACACCCGCTCCCACCATCGCCTCTCAACCTCTTAGTCTTCGCC CCGAGGCATGCCGACCCGCCGCCGGGGGTGCTGTTCATACGAG GGGCTTGGACTTCGCTTGTGATATTTACATTTGGGCTCCGTTGG CGGGTACGTGCGGCGTCCTTTTGTTGTCACTCGTTATTACTTTG TATTGTAATCACAGGAATCGCTCAAAGCGGAGTAGGTTGTTGC ATTCCGATTACATGAATATGACTCCTCGCCGGCCTGGGCCGAC AAGAAAACATTACCAACCCTATGCCCCCCCACGAGACTTCGCT GCGTACAGGTCCCGAGTGAAGTTTTCCCGAAGCGCAGACGCTC CGGCATATCAGCAAGGACAGAATCAGCTGTATAACGAACTGAA TTTGGACGCCGCGAGGAGTATGACGTGCTTGATAAACGCCGG GGGAGAGACCCGGAAATGGGGGGTAAACCCCGAAGAAAGAAT CCCCAAGAAGGACTCTACAATGAACTCCAGAAGGATAAGATG GCGGAGGCCTACTCAGAAATAGGTATGAAGGGCGAACGACGA CGGGGAAAAGGTCACGATGGCCTCTACCAAGGGTTGAGTACGG CAACCAAAGATACGTACGATGCACTGCATATGCAGGCCCTGCC TCCCAGA |
| 1430 | Anti-BCMA CAR of CTX-162 | ATGGCGCTTCCGGTGACAGCACTGCTCCTCCCCTTGGCGCTGTT GCTCCACGCAGCAAGGCCGGACATCCAGATGACCCAGAGCCCT AGCAGCCTGAGCGCTAGCGTGGGCGACAGGGTGACCATCACCT GCAGGGCCAGCCAGAGCGTGGACTCCAACGTGGCCTGGTACCA GCAGAAGCCCGAGAAGGCCCCCAAGAGCCTGATCTTCAGCGCC AGCCTGAGGTTCTCCGGAGTGCCTAGCAGATTTAGCGGCAGCG GCAGCGGCACAGACTTCACCCCTGACCATCAGCAGCCTCCAGCC CGAGGATTTCGCCACCTACTACTGCCAGCAGTACAACTCCTAC CCCCTGACCTTCGGCGCCGGCACAAAGCTGGAGATCAAGGGAG GAGGAGGAAGCGGAGGAGGAGGAAGCGGAGGCGGAGGAAGC GAGGTGCAGCTGGTGGAGTCCGGAGGAGGCCTGGTGCAACCTG GAGGCAGCCTGAAGCTGAGCTGTGCCGCCAGCGGAATCGACTT CAGCAGGTACTGGATGTCCTGGGTGAGACAGGCCCCTGGCAAG GGCCTGGAGTGGATCGGAGAGATCAACCCCGACAGCTCCACCA TCAACTACGCCGACAGCGTGAAGGGCAGGTTCACCATCAGCAG AGACAACGCCAAGAACACCCTGTACCTGCAGATGAACCTGTCC AGAGCCGAGGACACCGCCCTGTACTACTGCGCCAGCCTGTATT ACGACTACGGCGACGCTATGGACTACTGGGGCCAGGGCACCCT GGTGACAGTGAGCAGCAGTGCTGCTGCCTTTGTCCCGGTATTTC TCCCAGCCAAACCGACCACGACTCCCGCCCCGCGCCCTCCGAC ACCCGCTCCCACCATCGCCTCTCAACCTCTTAGTCTTCGCCCCG AGGCATGCCGACCCGCCGCCGGGGGTGCTGTTCATACGAGGGG CTTGGACTTCGCTTGTGATATTTACATTTGGGCTCCGTTGGCGG GTACGTGCGGCGTCCTTTTGTTGTCACTCGTTATTACTTTGTATT GTAATCACAGGAATCGCTCAAAGCGGAGTAGGTTGTTGCATTC CGATTACATGAATATGACTCCTCGCCGGCCTGGGCCGACAAGA AAACATTACCAACCCTATGCCCCCCCACGAGACTTCGCTGCGT ACAGGTCCCGAGTGAAGTTTTCCCGAAGCGCAGACGCTCCGGC ATATCAGCAAGGACAGAATCAGCTGTATAACGAACTGAATTTG GACGCCGCGAGGAGTATGACGTGCTTGATAAACGCCGGGGG AGAGACCCGGAAATGGGGGGTAAACCCCGAAGAAAGAATCCC CAAGAAGGACTCTACAATGAACTCCAGAAGGATAAGATGGCG GAGGCCTACTCAGAAATAGGTATGAAGGGCGAACGACGACGG GGAAAAGGTCACGATGGCCTCTACCAAGGGTTGAGTACGGCAA CCAAAGATACGTACGATGCACTGCATATGCAGGCCCTGCCTCC CAGA |

TABLE 36-continued

CAR Nucleotide Sequences

| SEQ ID NO: | Description | Sequence |
|---|---|---|
| 1431 | Anti-BCMA CAR of CTX-163 | ATGGCGCTTCCGGTGACAGCACTGCTCCTCCCCTTGGCGCTGTT<br>GCTCCACGCAGCAAGGCCGGACATCCAAATGACCCAGTCCCCT<br>AGCAGCCTGTCCGCCAGCCCTGGAGACAGGGTGTCCGTGACCT<br>GCAAGGCCAGCCAGTCCGTGGACAGCAACGTCGCCTGGTATCA<br>GCAGAAGCCCAGGCAAGCTCCCAAGGCTCTGATCTTCTCCGCC<br>AGCCTGAGATTTTCCGGCGTGCCCGCCAGATTCACCGGAAGCG<br>GCAGCGGCACCGACTTCACCCTGACCATCAGCAACCTGCAGAG<br>CGAGGATTTCGCCCACATACTACTGCCAGCAGTACAACAACTAC<br>CCCCTGACCTTCGGAGCCGGCACCAAGCTGGAGATCAAAGGCG<br>GCGGAGGCAGCGGCGGCGGCGGCAGCGGCGGAGGCGGATCCG<br>AAGTGCAGCTGGTGGAAAGCGGAGGCGGACTCGTGCAGCCTG<br>GCGGAAGCCTGAAGCTGAGCTGTGCCGCCAGCGGCATCGACTT<br>CAGCAGGTACTGGATGAGCTGGGTGAGGCAGGCTCCCGGCAA<br>AGGCCTGGAGTGGATCGGCGAGATCAACCCTGACAGCAGCACC<br>ATCAACTACGCCGACAGCGTGAAAGGCAGGTTCACCATCAGCA<br>GGGACAACGCCAAGAACACCCTGTACCTGCAGATGAACCTGTC<br>CAGAGCCGAGGACACCGCCCTGTACTACTGCGCCAGCCTGTAC<br>TACGACTACGGCGACGCTATGGACTACTGGGGCCAAGGCACCC<br>TCGTGACCGTCAGCTCCAGTGCTGCTGCCTTTGTCCCGGTATTT<br>CTCCCAGCCAAACCGACCACGACTCCCGCCCCGCGCCCTCCGA<br>CACCCGCTCCCACCATCGCCTCTCAACCTCTTAGTCTTCGCCCC<br>GAGGCATGCCGACCCGCCGCCGGGGGTGCTGTTCATACGAGGG<br>GCTTGGACTTCGCTTGTGATATTTACATTTGGGCTCCGTTGGCG<br>GGTACGTGCGGCGTCCTTTTGTTGTCACTCGTTATTACTTTGTAT<br>TGTAATCACAGGAATCGCTCAAAGCGGAGTAGGTTGTTGCATT<br>CCGATTACATGAATATGACTCCTCGCCGGCCTGGGCCGACAAG<br>AAAACATTACCAACCCTATGCCCCCCACGAGACTTCGCTGCG<br>TACAGGTCCCGAGTGAAGTTTTCCCGAAGCGCAGACGCTCCGG<br>CATATCAGCAAGGACAGAATCAGCTGTATAACGAACTGAATTT<br>GGGACGCCGCGAGGAGTATGACGTGCTTGATAAACGCCGGGG<br>GAGAGACCCGGAAATGGGGGTAAACCCCGAAGAAAGAATCC<br>CCAAGAAGGACTCTACAATGAACTCCAGAAGGATAAGATGGC<br>GGAGGCCTACTCAGAAATAGGTATGAAGGGCGAACGACGACG<br>GGGAAAAGGTCACGATGGCCTCTACCAAGGGTTGAGTACGGCA<br>ACCAAAGATACGTACGATGCACTGCATATGCAGGCCCTGCCTC<br>CCAGA |
| 1432 | Anti-BCMA CAR of CTX-164 | ATGGCGCTTCCGGTGACAGCACTGCTCCTCCCCTTGGCGCTGTT<br>GCTCCACGCAGCAAGGCCGGAGGTGCAGCTGCAGCAGTCCGGC<br>CCTGAGCTCGTGAAGCCTGGAGCCAGCGTGAAAATGAGCTGTA<br>AGGCCTCCGGCAACACCCTCACCAACTACGTGATCCATTGGAT<br>GAAGCAGATGCCCGGCCAGGGCCTGGACTGGATTGGCTACATT<br>CTGCCCTACAACGACCTGACCAAGTACAACGAGAAGTTCACCG<br>GCAAGGCCACCCTGACCAGCGATAAGAGCTCCAGCAGCGCCTA<br>CATGGAGCTGAACTCCCTGACCAGCGAGGACAGCGCCGTGTAC<br>TACTGCACCAGGTGGGACTGGGATGGCTTCTTCGACCCCTGGG<br>GACAGGGCACCACCCTGACAGTGTCCAGCGGAGGAGGCGGCA<br>GCGGCGGCGGCGGCTCCGGCGGCGGCGGCAGCGATATCGTGAT<br>GACACAGTCCCCTCTGAGCCTGCCTGTGAGCCTGGGCGACCAG<br>GCCAGCATCAGCTGCAGGTCCACCCAGTCCCTGGTGCACTCCA<br>ACGGCAACACCCACCTGCACTGGTACCTGCAAAGGCCCGGCCA<br>GTCCCCTAAGCTGCTGATCTACAGCGTGAGCAACAGGTTTAGC<br>GAGGTGCCCGATAGATTTTCCGCCAGCGGCAGCGGCACCGACT<br>TCACACTGAAGATCTCCAGGGTGGAGGCCGAGGATCTGGGCGT<br>GTACTTCTGCAGCCAGACCAGCCACATCCCCTACACCTTCGGC<br>GGCGGAACCAAGCTGGAGATCAAGAGTGCTGCTGCCTTTGTCC<br>CGGTATTTCTCCCAGCCAAACCGACCACGACTCCCGCCCCGCG<br>CCCTCCGACACCCGCTCCCACCATCGCCTCTCAACCTCTTAGTC<br>TTCGCCCCGAGGCATGCCGACCCGCCGCCGGGGGTGCTGTTCA<br>TACGAGGGGCTTGGACTTCGCTTGTGATATTTACATTTGGGCTC<br>CGTTGGCGGGTACGTGCGGCGTCCTTTTGTTGTCACTCGTTATT<br>ACTTTGTATTGTAATCACAGGAATCGCTCAAAGCGGAGTAGGT<br>TGTTGCATTCCGATTACATGAATATGACTCCTCGCCGGCCTGGG<br>CCGACAAGAAAACATTACCAACCCTATGCCCCCCACGAGACT<br>TCGCTGCGTACAGGTCCCGAGTGAAGTTTTCCCGAAGCGCAGA<br>CGCTCCGGCATATCAGCAAGGACAGAATCAGCTGTATAACGAA<br>CTGAATTTGGGACGCCGCGAGGAGTATGACGTGCTTGATAAAC<br>GCCGGGGGAGAGACCCGGAAATGGGGGTAAACCCCGAAGAA<br>AGAATCCCCAAGAAGGACTCTACAATGAACTCCAGAAGGATA<br>AGATGGCGGAGGCCTACTCAGAAATAGGTATGAAGGGCGAAC<br>GACGACGGGGAAAAGGTCACGATGGCCTCTACCAAGGGTTGA<br>GTACGGCAACCAAAGATACGTACGATGCACTGCATATGCAGGC<br>CCTGCCTCCCAGA |

TABLE 36-continued

CAR Nucleotide Sequences

| SEQ ID NO: | Description | Sequence |
| --- | --- | --- |
| 1433 | Anti-BCMA CAR of CTX-165 | ATGGCGCTTCCGGTGACAGCACTGCTCCTCCCCTTGGCGCTGTT<br>GCTCCACGCAGCAAGGCCGGACATCGTGATGACCCAGAGCCCC<br>CTGAGCCTGCCTGTGTCCCTGGGAGACCAGGCTTCCATCAGCT<br>GCAGGTCCACCCAGAGCCTGGTGCACTCCAACGGCAACACCCA<br>CCTGCACTGGTACCTGCAGAGGCCTGGCCAGTCCCCCAAGCTG<br>CTGATCTACAGCGTGAGCAATAGGTTCAGCGAGGTGCCCGACA<br>GATTCAGCGCCAGCGGAAGCGGCACCGACTTCACCCTGAAGAT<br>CAGCAGGGTCGAGGCCGAAGATCTGGGCGTGTACTTCTGCTCC<br>CAGACATCCCACATCCCTTACACCTTCGGCGGCGGCACCAAGC<br>TGGAGATTAAGGGCGGCGGAGGATCCGGCGGAGGAGGATCCG<br>GAGGAGGAGGAAGCGAGGTGCAGCTGCAGCAGAGCGGACCCG<br>AGCTGGTGAAACCCGGAGCCAGCGTCAAAATGAGCTGCAAGG<br>CCAGCGGCAACACCCTGACCAACTACGTCATCCACTGGATGAA<br>GCAGATGCCCGGACAGGGCCTGGACTGGATCGGCTACATCCTG<br>CCCTACAACGACCTGACCAAGTACAACGAGAAATTCACCGGCA<br>AGGCCACCCTGACCAGCGACAAGAGCAGCAGCAGCGCCTACA<br>TGGAGCTGAACAGCCTGACCAGCGAGGACTCCGCCGTGTACTA<br>TTGCACCAGGTGGGACTGGGACGGCTTCTTTGACCCCTGGGGC<br>CAGGGCACAACACTCACCGTGAGCTCCAGTGCTGCTGCCTTTG<br>TCCCGGTATTTCTCCCAGCCAAACCGACCACGACTCCCGCCCCG<br>CGCCCTCCGACACCCGCTCCCACCATCGCCTCTCAACCTCTTAG<br>TCTTCGCCCCGAGGCATGCCGACCCGCCGCCGGGGGTGCTGTT<br>CATACGAGGGGCTTGGACTTCGCTTGTGATATTTACATTTGGGC<br>TCCGTTGGCGGGTACGTGCGGCGTCCTTTTGTTGTCACTCGTTA<br>TTACTTTGTATTGTAATCACAGGAATCGCTCAAAGCGGAGTAG<br>GTTGTTGCATTCCGATTACATGAATATGACTCCTCGCCGGCCTG<br>GGCCGACAAGAAAACATTACCAACCCTATGCCCCCCACGAGA<br>CTTCGCTGCGTACAGGTCCCGAGTGAAGTTTTCCCGAAGCGCA<br>GACGCTCCGGCATATCAGCAAGGACAGAATCAGCTGTATAACG<br>AACTGAATTTGGGACGCCGCGAGGAGTATGACGTGCTTGATAA<br>ACGCCGGGGAGAGACCCGGAAATGGGGGGTAAACCCCGAAG<br>AAAGAATCCCCAAGAAGGACTCTACAATGAACTCCAGAAGGA<br>TAAGATGGCGGAGGCCTACTCAGAAATAGGTATGAAGGGCGA<br>ACGACGACGGGGAAAAGGTCACGATGGCCTCTACCAAGGGTT<br>GAGTACGGCAACCAAAGATACGTACGATGCACTGCATATGCAG<br>GCCCTGCCTCCCAGA |
| 1434 | Anti-BCMA CAR of CTX-166 | ATGGCGCTTCCGGTGACAGCACTGCTCCTCCCCTTGGCGCTGTT<br>GCTCCACGCAGCAAGGCCGCAGGTGCAGCTGGTGCAGAGCGG<br>AGCCGAGCTCAAGAAGCCCGGAGCCTCCGTGAAGGTGAGCTGC<br>AAGGCCAGCGGCAACACCCTGACCAACTACGTGATCCACTGGG<br>TGAGACAAGCCCCCGGCCAAAGGCTGGAGTGGATGGGCTACAT<br>CCTGCCCTACAACGACCTGACCAAGTACAGCCAGAAGTTCCAG<br>GGCAGGGTGACCATCACCAGGGATAAGAGCGCCTCCACCGCCT<br>ATATGGAGCTGAGCAGCCTGAGGAGCGAGGACACCGCTGTGTA<br>CTACTGTACAAGGTGGGACTGGGACGGCTTCTTTGACCCCTGG<br>GGCCAGGGCACAACAGTGACCGTCAGCAGCGGCGGCGGAGGC<br>AGCGGCGGCGGCGGCAGCGGCGGAGGCGGAAGCGAAATCGTG<br>ATGACCCAGAGCCCCGCCACACTGAGCGTGAGCCCTGGCGAGA<br>GGGCCAGCATCTCCTGCAGGGCTAGCCAAAGCCTGGTGCACAG<br>CAACGGCAACACCCACCTGCACTGGTACCAGCAGAGACCCGGA<br>CAGGCTCCCAGGCTGCTGATCTACAGCGTGAGCAACAGGTTCT<br>CCGAGGTGCCTGCCAGGTTTAGCGGCAGCGGAAGCGGCACCGA<br>CTTTACCCTGACCATCAGCAGCGTGGAGTCCGAGGACTTCGCC<br>GTGTATTACTGCAGCCAGACCAGCCACATCCCTTACACCTTCGG<br>CGGCGGCACCAAGCTGGAGATCAAAAGTGCTGCTGCCTTTGTC<br>CCGGTATTTCTCCCAGCCAAACCGACCACGACTCCCGCCCCGC<br>GCCCTCCGACACCCGCTCCCACCATCGCCTCTCAACCTCTTAGT<br>CTTCGCCCCGAGGCATGCCGACCCGCCGCCGGGGGTGCTGTTC<br>ATACGAGGGGCTTGGACTTCGCTTGTGATATTTACATTTGGGCT<br>CCGTTGGCGGGTACGTGCGGCGTCCTTTTGTTGTCACTCGTTAT<br>TACTTTGTATTGTAATCACAGGAATCGCTCAAAGCGGAGTAGG<br>TTGTTGCATTCCGATTACATGAATATGACTCCTCGCCGGCCTGG<br>GCCGACAAGAAAACATTACCAACCCTATGCCCCCCACGAGAC<br>TTCGCTGCGTACAGGTCCCGAGTGAAGTTTTCCCGAAGCGCAG<br>ACGCTCCGGCATATCAGCAAGGACAGAATCAGCTGTATAACGA<br>ACTGAATTTGGGACGCCGCGAGGAGTATGACGTGCTTGATAAA<br>CGCCGGGGAGAGACCCGGAAATGGGGGGTAAACCCCGAAGA<br>AGATCCCCAAGAAGGACTCTACAATGAACTCCAGAAGGAT<br>AAGATGGCGGAGGCCTACTCAGAAATAGGTATGAAGGGCGAA<br>CGACGACGGGGAAAAGGTCACGATGGCCTCTACCAAGGGTTG<br>AGTACGGCAACCAAAGATACGTACGATGCACTGCATATGCAGG<br>CCCTGCCTCCCAGA |

TABLE 36-continued

CAR Nucleotide Sequences

| SEQ ID NO: | Description | Sequence |
|---|---|---|
| 1435 | Anti-BCMA CAR of CTX-166b | ATGGCGCTTCCGGTGACAGCACTGCTCCTCCCCTTGGCGCTGTT GCTCCACGCAGCAAGGCCGCAGGTGCAGCTGGTGCAGAGCGG AGCCGAGCTCAAGAAGCCCGGAGCCTCCGTGAAGGTGAGCTGC AAGGCCAGCGGCAACACCCTGACCAACTACGTGATCCACTGGG TGAGACAAGCCCCCGGCCAAAGGCTGGAGTGGATGGGCTACAT CCTGCCCTACAACGACCTGACCAAGTACAGCCAGAAGTTCCAG GGCAGGGTGACCATCACCAGGGATAAGAGCGCCTCCACCGCCT ATATGGAGCTGAGCAGCCTGAGGAGCGAGGACACCGCTGTGTA CTACTGTACAAGGTGGGACTGGGACGGCTTCTTTGACCCCTGG GGCCAGGGCACAACAGTGACCGTCAGCAGCGGCGGCGGAGGC AGCGGCGGCGGCGGCAGCGGCGGAGGCGGAAGCGAAATCGTG ATGACCCAGAGCCCCGCCACACTGAGCGTGAGCCCTGGCGAGA GGGCCAGCATCTCCTGCAGGGCTAGCCAAAGCCTGGTGCACAG CAACGGCAACACCCACCTGCACTGGTACCAGCAGAGACCCGGA CAGGCTCCCAGGCTGCTGATCTACAGCGTGAGCAACAGGTTCT CCGAGGTGCCTGCCAGGTTTAGCGGCAGCGGAAGCGGCACCGA CTTTACCCTGACCATCAGCAGCGTGGAGTCCGAGGACTTCGCC GTGTATTACTGCAGCCAGACCAGCCACATCCCTTACACCTTCGG CGGCGGCACCAAGCTGGAGATCAAAAGTGCTGCTGCCTTTGTC CCGGTATTTCTCCCAGCCAAACCGACCACGACTCCCGCCCCGC GCCCTCCGACACCCGCTCCCACCATCGCCTCTCAACCTCTTAGT CTTCGCCCCGAGGCATGCCGACCCGCCGCCGGGGTGCTGTTC ATACGAGGGGCTTGGACTTCGCTTGTGATATTTACATTTGGGCT CCGTTGGCGGGTACGTGCGGCGTCCTTTTGTTGTCACTCGTTAT TACTTTGTATTGTAATCACAGGAATCGCAAACGGGGCAGAAAG AAACTCCTGTATATATTCAAACAACCATTTATGAGACCAGTAC AAACTACTCAAGAGGAAGATGGCTGTAGCTGCCGATTTCCAGA AGAAGAAGGAGGATGTGAACTGCGAGTGAAGTTTTCCCG AAGCGCAGACGCTCCGGCATATCAGCAAGGACAGAATCAGCT GTATAACGAACTGAATTTGGGACGCCGCGAGGAGTATGACGTG CTTGATAAACGCCGGGGAGAGACCCGGAAATGGGGGGTAAA CCCCGAAGAAAGAATCCCCAAGAAGGACTCTACAATGAACTCC AGAAGGATAAGATGGCGGAGGCCTACTCAGAAATAGGTATGA AGGGCGAACGACGACGGGGAAAAGGTCACGATGGCCTCTACC AAGGGTTGAGTACGGCAACCAAAGATACGTACGATGCACTGCA TATGCAGGCCCTGCCTCCCAGA |
| 1436 | Anti-BCMA CAR of CTX-167 | ATGGCGCTTCCGGTGACAGCACTGCTCCTCCCCTTGGCGCTGTT GCTCCACGCAGCAAGGCCGCAGGTGCAGCTGGTGCAGAGCGG CGCCGAGCTGAAGAAACCTGGCGCCAGCGTCAAGGTGAGCTGC AAGGCTTCCGGAAACACCCTCACCAACTACGTGATCCACTGGG TGAGGCAGGCCCCCGGACAGAGACTGGAGTGGATGGGCTACA TTCTGCCCTACAACGACCTGACCAAGTACAGCCAGAAGTTCCA GGGCAGGGTCACCATCACCAGGGACAAGAGCGCCAGCACCGC CTACATGGAGCTGAGCAGCCTGAGGTCCGAGGACACAGCCGTG TACTACTGCACCAGGTGGGACTGGGACGGATTCTTCGACCCTT GGGGCCAAGGCACCACAGTGACAGTGAGCTCCGGCGGAGGCG GCAGCGGCGGCGGAGGAAGCGGCGGCGGCGGAAGCGACATCG TGATGACCCAGAGCCCTCTGAGCCTGCCCGTGACACTGGGACA GCCTGCCACACTGTCCTGCAGGAGCACCCAGAGCCTGGTGCAT AGCAACGGCAACACCCACCTGCACTGGTTCCAGCAGAGACCTG GCCAGAGCCCCCTGAGACTGATCTACAGCGTGAGCAACAGGGA CAGCGGCGTGCCCGATAGATTTAGCGGCAGCGGCAGCGGCACC GACTTTACCCTGAAAATCTCCAGGGTGGAGGCCGAGGATGTGG GCGTGTATTACTGCTCCCAGACAAGCCACATTCCCTATACATTC GGCGGCGGCACCAAGCTGGAGATCAAGAGTGCTGCTGCCTTTG TCCCGGTATTTCTCCCAGCCAAACCGACCACGACTCCCGCCCCG CGCCCTCCGACACCCGCTCCCACCATCGCCTCTCAACCTCTTAG TCTTCGCCCCGAGGCATGCCGACCCGCCGCCGGGGTGCTGTT CATACGAGGGGCTTGGACTTCGCTTGTGATATTTACATTTGGGC TCCGTTGGCGGGTACGTGCGGCGTCCTTTTGTTGTCACTCGTTA TTACTTTGTATTGTAATCACAGGAATCGCTCAAAGCGGAGTAG GTTGTTGCATTCCGATTACATGAATATGACTCCTCGCCGGCCTG GGCCGACAAGAAAACATTACCAACCCTATGCCCCCCACGAGA CTTCGCTGCGTACAGGTCCCGAGTGAAGTTTTCCCGAAGCGCA GACGCTCCGGCATATCAGCAAGGACAGAATCAGCTGTATAACG AACTGAATTTGGGACGCCGCGAGGAGTATGACGTGCTTGATAA ACGCCGGGGAGAGACCCGGAAATGGGGGGTAAACCCCGAAG AAAGAATCCCCAAGAAGGACTCTACAATGAACTCCAGAAGGA TAAGATGGCGGAGGCCTACTCAGAAATAGGTATGAAGGGCGA ACGACGACGGGGAAAAGGTCACGATGGCCTCTACCAAGGGTT GAGTACGGCAACCAAAGATACGTACGATGCACTGCATATGCAG GCCCTGCCTCCCAGA |

TABLE 36-continued

CAR Nucleotide Sequences

| SEQ ID NO: | Description | Sequence |
| --- | --- | --- |
| 1437 | Anti-BCMA CAR of CTX-168 | ATGGCGCTTCCGGTGACAGCACTGCTCCTCCCCTTGGCGCTGTT GCTCCACGCAGCAAGGCCGGAAATCGTGATGACCCAGAGCCCT GCCACACTGAGCGTGAGCCCTGGCGAGAGAGCCAGCATCAGCT GCAGGGCCTCCCAGAGCCTGGTGCACTCCAACGGCAATACCCA CCTGCACTGGTATCAGCAGAGACCCGGCCAGGCCCCTAGGCTG CTGATCTACTCCGTGAGCAACAGGTTCTCCGAGGTGCCCGCCA GATTCAGCGGATCCGGCAGCGGCACCGACTTCACCCTCACCAT CTCCAGCGTGGAGAGCGAGGACTTCGCCGTCTACTACTGCAGC CAGACAAGCCACATCCCCTACACCTTCGGCGGCGGCACCAAGC TGGAGATCAAGGGCGGCGGCGGCAGCGGCGGCGGAGGCAGCG GAGGCGGCGGATCCCAGGTGCAACTGGTGCAGAGCGGAGCCG AGCTGAAGAAGCCCGGAGCCAGCGTGAAGGTCAGCTGCAAGG CCAGCGGCAACACCCTGACAAACTACGTGATCCACTGGGTGAG GCAGGCCCCTGGCCAAAGGCTCGAGTGGATGGGCTACATCCTC CCCTACAACGACCTGACCAAGTACTCCCAGAAGTTCCAGGGCA GGGTGACCATCACCAGGGATAAGAGCGCCAGCACCGCCTACAT GGAACTCAGCAGCCTGAGGAGCGAGGACACCGCCGTGTACTAC TGCACCAGGTGGGACTGGGATGGCTTCTTCGACCCTTGGGGCC AGGGCACCACCGTGACAGTGAGCTCCAGTGCTGCTGCCTTTGT CCCGGTATTTCTCCCAGCCAAACCGACCACGACTCCCGCCCCG CGCCCTCCGACACCCGCTCCCACCATCGCCTCTCAACCTCTTAG TCTTCGCCCCGAGGCATGCCGACCCGCCGCCGGGGGTGCTGTT CATACGAGGGGCTTGGACTTCGCTTGTGATATTTACATTTGGGC TCCGTTGGCGGGTACGTGCGGCGTCCTTTTGTTGTCACTCGTTA TTACTTTGTATTGTAATCACAGGAATCGCTCAAAGCGGAGTAG GTTGTTGCATTCCGATTACATGAATATGACTCCTCGCCGGCCTG GGCCGACAAGAAAACATTACCAACCCTATGCCCCCCCACGAGA CTTCGCTGCGTACAGGTCCCGAGTGAAGTTTTCCCGAAGCGCA GACGCTCCGGCATATCAGCAAGGACAGAATCAGCTGTATAACG AACTGAATTTGGGACGCCGCGAGGAGTATGACGTGCTTGATAA ACGCCGGGGAGAGACCCGGAAATGGGGGGTAAACCCCGAAG AAAGAATCCCCAAGAAGGACTCTACAATGAACTCCAGAAGGA TAAGATGGCGGAGGCCTACTCAGAAATAGGTATGAAGGGCGA ACGACGACGGGGAAAAGGTCACGATGGCCTCTACCAAGGGTT GAGTACGGCAACCAAAGATACGTACGATGCACTGCATATGCAG GCCCTGCCTCCCAGA |
| 1438 | Anti-BCMA CAR of CTX-169 | ATGGCGCTTCCGGTGACAGCACTGCTCCTCCCCTTGGCGCTGTT GCTCCACGCAGCAAGGCCGGACATCGTGATGACACAATCCCCC CTCAGCCTGCCTGTGACACTGGGCCAGCCTGCCACCCTGAGCT GCAGGAGCACCCAGTCCCTGGTGCACTCCAACGGCAACACCCA CCTGCACTGGTTCCAGCAGAGGCCTGGACAGAGCCCCCTGAGG CTGATCTACAGCGTGAGCAACAGGGACTCCGGCGTGCCCGATA GATTCAGCGGCAGCGGCTCCGGCACCGATTTCACCCTGAAGAT CTCCAGAGTGGAAGCCGAGGACGTGGGCGTCTACTACTGCAGC CAGACCAGCCATATCCCCTACACCTTCGGCGGCGGCACCAAGC TGGAGATCAAGGGAGGCGGCGGAAGCGGCGGAGGCGGATCCG GAGGCGGAGGCTCCCAAGTGCAGCTGGTGCAGAGCGGCGCTG AGCTGAAGAAGCCCGGAGCCAGCGTGAAGGTGAGCTGCAAGG CCAGCGGAAACACCCTGACCAACTACGTGATCCACTGGGTGAG ACAGGCCCCCGGACAGAGACTCGAGTGGATGGGCTACATCCTG CCCTACAACGACCTGACCAAGTACAGCCAGAAGTTCCAGGGCA GGGTGACAATCACCAGGGACAAGAGCGCCAGCACCGCCTACA TGGAGCTGAGCAGCCTGAGATCCGAGGACACCGCCGTGTACTA CTGCACCAGGTGGGACTGGGACGGCTTCTTTGACCCCTGGGGC CAGGGAACCACAGTGACCGTGTCCTCCAGTGCTGCTGCCTTTGT CCCGGTATTTCTCCCAGCCAAACCGACCACGACTCCCGCCCCG CGCCCTCCGACACCCGCTCCCACCATCGCCTCTCAACCTCTTAG TCTTCGCCCCGAGGCATGCCGACCCGCCGCCGGGGGTGCTGTT CATACGAGGGGCTTGGACTTCGCTTGTGATATTTACATTTGGGC TCCGTTGGCGGGTACGTGCGGCGTCCTTTTGTTGTCACTCGTTA TTACTTTGTATTGTAATCACAGGAATCGCTCAAAGCGGAGTAG GTTGTTGCATTCCGATTACATGAATATGACTCCTCGCCGGCCTG GGCCGACAAGAAAACATTACCAACCCTATGCCCCCCCACGAGA CTTCGCTGCGTACAGGTCCCGAGTGAAGTTTTCCCGAAGCGCA GACGCTCCGGCATATCAGCAAGGACAGAATCAGCTGTATAACG AACTGAATTTGGGACGCCGCGAGGAGTATGACGTGCTTGATAA ACGCCGGGGAGAGACCCGGAAATGGGGGGTAAACCCCGAAG AAAGAATCCCCAAGAAGGACTCTACAATGAACTCCAGAAGGA TAAGATGGCGGAGGCCTACTCAGAAATAGGTATGAAGGGCGA ACGACGACGGGGAAAAGGTCACGATGGCCTCTACCAAGGGTT GAGTACGGCAACCAAAGATACGTACGATGCACTGCATATGCAG GCCCTGCCTCCCAGA |

TABLE 36-continued

CAR Nucleotide Sequences

| SEQ ID NO: | Description | Sequence |
|---|---|---|
| 1439 | Anti-BCMA CAR of CTX-170 | ATGGCGCTTCCGGTGACAGCACTGCTCCTCCCCTTGGCGCTGTT GCTCCACGCAGCAAGGCCGGAGGTGCAGCTGCAGCAGAGCGG CCCTGAGCTGGTGAAGCCCGGCGCCAGCGTGAAGATCAGCTGC AAGACCTCCGGCTATACCTTTACCGAGTACACCATCAACTGGG TGAAGCAGAGCCACGGCAAGAGCCTGGAGTGGATCGGCGATA TCTACCCCGACAACTACAACATCAGGTACAACCAGAAGTTCAA GGGCAAGGCCACCCTGACCGTGGACAAGTCCAGCAGCACCGCC TACATGGAGCTGAGGAGCCTGTCCAGCGAGGACTCCGCCATCT ACTACTGCGCCAACCACGACTTTTTCGTCTTCTGGGGACAGGGC ACCCTGGTGACAGTGTCCGCTGGCGGCGGCGGCAGCGGCGGCG GCGGCTCCGGAGGCGGCGGCAGCGACATCCAGATGACACAGG CCACAAGCTCCCTGTCCGCCAGCCTGGGCGATAGGGTGACCAT CAATTGCAGGACCTCCCAGGACATCAGCAACCACCTGAACTGG TACCAGCAGAAACCCGACGGCACCGTGAAGCTGCTCATCTACT ACACCAGCAGGCTGCAGTCCGGCGTCCCTAGCAGATTCAGCGG ATCCGGCAGCGGCACCGACTATAGCCTGACCATCAGCAACCTC GAGCAGGAGGACATCGGCACCTACTTCTGCCATCAGGGCAACA CCCTGCCCCCTACCTTTGGCGGCGGCACAAAGCTGGAGATTAA GAGTGCTGCTGCCTTTGTCCCGGTATTTCTCCCAGCCAAACCGA CCACGACTCCCGCCCCGCCCTCCGACACCCGCTCCCACCATC GCCTCTCAACCTCTTAGTCTTCGCCCCGAGGCATGCCGACCCGC CGCCGGGGGTGCTGTTCATACGAGGGGCTTGGACTTCGCTTGT GATATTTACATTTGGGCTCCGTTGGCGGGTACGTGCGGCGTCCT TTTGTTGTCACTCGTTATTACTTTGTATTGTAATCACAGGAATC GCTCAAAGCGGAGTAGGTTGTTGCATTCCGATTACATGAATAT GACTCCTCGCCGGCCTGGGCCGACAAGAAAACATTACCAACCC TATGCCCCCCACGAGACTTCGCTGCGTACAGGTCCCGAGTGA AGTTTTCCCGAAGCGCAGACGCTCCGGCATATCAGCAAGGACA GAATCAGCTGTATAACGAACTGAATTTGGGACGCCGCGAGGAG TATGACGTGCTTGATAAACGCCGGGGAGAGACCCGGAAATG GGGGGTAAACCCCGAAGAAAGAATCCCCAAGAAGGACTCTAC AATGAACTCCAGAAGGATAAGATGGCGGAGGCCTACTCAGAA ATAGGTATGAAGGGCGAACGACGACGGGGAAAAGGTCACGAT GGCCTCTACCAAGGGTTGAGTACGGCAACCAAAGATACGTACG ATGCACTGCATATGCAGGCCCTGCCTCCCAGA |
| 1440 | Anti-BCMA CAR of CTX-171 | ATGGCGCTTCCGGTGACAGCACTGCTCCTCCCCTTGGCGCTGTT GCTCCACGCAGCAAGGCCGGATATCCAGATGACCCAGGCCACC AGCAGCCTGAGCGCTTCCCTCGGCGACAGGGTGACCATCAACT GCAGGACCAGCCAGGACATCTCCAACCACCTGAACTGGTACCA GCAGAAGCCCGACGGCACCGTGAAACTGCTGATCTACTACACC AGCAGACTGCAGAGCGGCGTGCCCTCCAGATTTTCCGGCAGCG GCTCCGGCACCGACTACAGCCTGACCATTAGCAACCTGGAGCA GGAGGACATCGGAACCTACTTCTGCCACCAGGGCAACACACTG CCTCCCACCTTCGGCGGCGGCACAAAGCTCGAGATCAAGGGCG GCGGCGGAAGCGGCGGCGGCGGCAGCGGCGGCGGAGGCTCCG AGGTGCAACTGCAACAGAGCGGACCTGAGCTGGTGAAGCCTG GCGCCAGCGTGAAGATCTCCTGTAAGACCAGCGGCTACACCTT CACCGAGTACACCATCAACTGGGTGAAGCAGAGCCACGGCAA GAGCCTCGAATGGATCGGCGACATCTATCCCGACAACTACAAT ATCAGATACAACCAGAAGTTCAAGGGAAAGGCCACCCTGACC GTGGATAAGTCCTCCTCCACCGCTTACATGGAGCTGAGGAGCC TGAGCAGCGAGGACTCCGCCATCTACTACTGCGCCAACCACGA CTTCTTCGTGTTCTGGGGCCAAGGCACCCTCGTGACCGTGAGCG CCAGTGCTGCTGCCTTTGTCCCGGTATTTCTCCCAGCCAAACCG ACCACGACTCCCGCCCCGCGCCCTCCGACACCCGCTCCCACCA TCGCCTCTCAACCTCTTAGTCTTCGCCCCGAGGCATGCCGACCC GCCGCGGGGTGCTGTTCATACGAGGGGCTTGGACTTCGCTT GTGATATTTACATTTGGGCTCCGTTGGCGGGTACGTGCGGCGTC CTTTTGTTGTCACTCGTTATTACTTTGTATTGTAATCACAGGAAT CGCTCAAAGCGGAGTAGGTTGTTGCATTCCGATTACATGAATA TGACTCCTCGCCGGCCTGGGCCGACAAGAAAACATTACCAACC CTATGCCCCCCACGAGACTTCGCTGCGTACAGGTCCCGAGTG AAGTTTTCCCGAAGCGCAGACGCTCCGGCATATCAGCAAGGAC AGAATCAGCTGTATAACGAACTGAATTTGGGACGCCGCGAGGA GTATGACGTGCTTGATAAACGCCGGGGAGAGACCCGGAAAT GGGGGGTAAACCCCGAAGAAAGAATCCCCAAGAAGGACTCTA CAATGAACTCCAGAAGGATAAGATGGCGGAGGCCTACTCAGA AATAGGTATGAAGGGCGAACGACGACGGGGAAAAGGTCACGA TGGCCTCTACCAAGGGTTGAGTACGGCAACCAAAGATACGTAC GATGCACTGCATATGCAGGCCCTGCCTCCCAGA |
| 1441 | Anti-BCMA CAR of CTX-172 | ATGGCGCTTCCGGTGACAGCACTGCTCCTCCCCTTGGCGCTGTT GCTCCACGCAGCAAGGCCGCAGGTGCAGCTGGTGCAGTCCGGC GCTGAGCTGAAGAAGCCCGGCGCCAGCGTGAAGATCAGCTGC |

TABLE 36-continued

CAR Nucleotide Sequences

| SEQ ID NO: | Description | Sequence |
|---|---|---|
| | | AAGGCCAGCGGCTACACCTTCACCGAATACACCATCAACTGGG<br>TGAGACAGGCCCCTGGACAGAGGCTCGAGTGGATGGGCGACA<br>TCTACCCCGACAACTACAGCATCAGGTACAACCAGAAGTTCCA<br>GGGCAGGGTGACAATCACCAGGGACACCAGCGCCAGCACCGC<br>CTATATGGAGCTGAGCAGCCTGAGATCCGAGGACACCGCCGTC<br>TATTACTGCGCCAACCACGACTTCTTCGTGTTCTGGGGCCAGGG<br>AACACTGGTGACCGTGTCCAGCGGCGGCGGCGGCAGCGGCGG<br>CGGAGGAAGCGGCGGCGGCGGCAGCGATATCCAGATGACCCA<br>GAGCCCCTCCTCCCTGAGCGCTAGCGTGGGCGACAGGGTGACC<br>ATTACCTGTCAGGCCTCCCAGGACATCAGCAACTACCTGAACT<br>GGTACCAGCAGAAGCCTGGCAAGGCCCCCAAGCTGCTGATCTA<br>TTACACCAGCAGGCTGGAGACCGGCGTGCCCTCCAGATTCAGC<br>GGCTCCGGCTCCGGAACCGACTTCACCTTCACCATCAGCTCCCT<br>GCAGCCTGAGGACATCGCCACCTACTACTGCCAGCAGGGCAAC<br>ACCCTGCCTCCCACATTCGGCGGCGGCACAAAGGTGGAGATCA<br>AAAGTGCTGCTGCCTTTGTCCCGGTATTCTCCCAGCCAAACCG<br>ACCACGACTCCCGCCCCGCGCCCTCCGACACCCGCTCCCACCA<br>TCGCCTCTCAACCTCTTAGTCTTCGCCCCGAGGCATGCCGACCC<br>GCCGCCGGGGGTGCTGTTCATACGAGGGGCTTGGACTTCGCTT<br>GTGATATTTACATTTGGGCTCCGTTGGCGGGTACGTGCGGCGTC<br>CTTTTGTTGTCACTCGTTATTACTTTGTATTGTAATCACAGGAAT<br>CGCTCAAAGCGGAGTAGGTTGTTGCATTCCGATTACATGAATA<br>TGACTCCTCGCCGGCCTGGGCCGACAAGAAAACATTACCAACC<br>CTATGCCCCCCACGAGACTTCGCTGCGTACAGGTCCCGAGTG<br>AAGTTTTCCCGAAGCGCAGACGCTCCGGCATATCAGCAAGGAC<br>AGAATCAGCTGTATAACGAACTGAATTTGGGACGCCGCGAGGA<br>GTATGACGTGCTTGATAAACGCCGGGGAGAGACCCGGAAAT<br>GGGGGGTAAACCCCGAAGAAAGAATCCCCAAGAAGGACTCTA<br>CAATGAACTCCAGAAGGATAAGATGGCGGAGGCCTACTCAGA<br>AATAGGTATGAAGGGCGAACGACGACGGGGAAAAGGTCACGA<br>TGGCCTCTACCAAGGGTTGAGTACGGCAACCAAAGATACGTAC<br>GATGCACTGCATATGCAGGCCCTGCCTCCCAGA |
| 1442 | Anti-BCMA<br>CAR of CTX-<br>173 | ATGGCGCTTCCGGTGACAGCACTGCTCCTCCCCTTGGCGCTGTT<br>GCTCCACGCAGCAAGGCCGCAGGTGCAGCTGGTCCAGTCCGGC<br>GCCGAACTGAAGAAGCCTGGCGCCAGCGTGAAGATCAGCTGC<br>AAGGCCTCCGGCTACACCTTCACCGAGTACACCATCAACTGGG<br>TGAGGCAAGCCCCCGGCCAGAGACTGGAGTGGATGGGCGACA<br>TCTACCCCGACAACTACAGCATCAGGTACAACCAGAAGTTCCA<br>GGGCAGGGTGACAATCACCAGGGATACCAGCGCCAGCACAGC<br>CTATATGGAGCTGTCCTCCCTGAGATCCGAGGACACCGCCGTG<br>TATTACTGCGCCAACCACGACTTCTTCGTGTTCTGGGGCCAAGG<br>CACCCTGGTGACCGTGAGCAGCGGCGGCGGCGGCTCCGGCGGC<br>GGAGGCTCCGGAGGCGGAGGCAGCGACATCCAGATGACCCAG<br>AGCCCTTCCAGCCTGAGCGCTAGCCTGGGCGACAGGGTGACCA<br>TCACCTGCAGGACCAGCCAGGACATCAGCAATCACCTGAACTG<br>GTACCAGCAAAAGCCCGGCAAGGCCCCTAAGCTGCTGATCTAC<br>TACACCAGCAGGCTGGAAAGCGGCGTGCCTAGCAGGTTCAGCG<br>GCAGCGGCTCCGGAACCGACTACAGCCTGACCATTAGCAGCCT<br>GCAACCTGAGGACATCGGCACCTATTACTGCCAGCAGGGCAAC<br>ACCCTGCCTCCTACCTTTGGCGGCGGCACCAAACTCGAGATCA<br>AGAGTGCTGCTGCCTTTGTCCCGGTATTCTCCCAGCCAAACCG<br>ACCACGACTCCCGCCCCGCGCCCTCCGACACCCGCTCCCACCA<br>TCGCCTCTCAACCTCTTAGTCTTCGCCCCGAGGCATGCCGACCC<br>GCCGCCGGGGGTGCTGTTCATACGAGGGGCTTGGACTTCGCTT<br>GTGATATTTACATTTGGGCTCCGTTGGCGGGTACGTGCGGCGTC<br>CTTTTGTTGTCACTCGTTATTACTTTGTATTGTAATCACAGGAAT<br>CGCTCAAAGCGGAGTAGGTTGTTGCATTCCGATTACATGAATA<br>TGACTCCTCGCCGGCCTGGGCCGACAAGAAAACATTACCAACC<br>CTATGCCCCCCACGAGACTTCGCTGCGTACAGGTCCCGAGTG<br>AAGTTTTCCCGAAGCGCAGACGCTCCGGCATATCAGCAAGGAC<br>AGAATCAGCTGTATAACGAACTGAATTTGGGACGCCGCGAGGA<br>GTATGACGTGCTTGATAAACGCCGGGGAGAGACCCGGAAAT<br>GGGGGGTAAACCCCGAAGAAAGAATCCCCAAGAAGGACTCTA<br>CAATGAACTCCAGAAGGATAAGATGGCGGAGGCCTACTCAGA<br>AATAGGTATGAAGGGCGAACGACGACGGGGAAAAGGTCACGA<br>TGGCCTCTACCAAGGGTTGAGTACGGCAACCAAAGATACGTAC<br>GATGCACTGCATATGCAGGCCCTGCCTCCCAGA |
| 1443 | Anti-BCMA<br>CAR of CTX-<br>174 | ATGGCGCTTCCGGTGACAGCACTGCTCCTCCCCTTGGCGCTGTT<br>GCTCCACGCAGCAAGGCCGCAGGTGCAGCTGGTGCAGAGCGG<br>CCCTGAGCTGAAGAAGCCCGGAGCCAGCGTGAAGATCTCCTGC<br>AAGACCTCCGGCTACACCTTCACCGAGTACACCATCAACTGGG<br>TGAAGCAGGCCCCCGGACAGGGACTGGAATGGATCGGCGACA<br>TCTACCCCGACAACTACAACATCAGGTACAACCAGAAGTTCCA<br>AGGCAAGGCCACCATCACAAGGGACACCAGCAGCAGCACCGC |

TABLE 36-continued

CAR Nucleotide Sequences

| SEQ ID NO: | Description | Sequence |
|---|---|---|
| | | CTACATGGAGCTGAGCAGCCTGAGGAGCGAGGATACCGCCGTG<br>TACTACTGCGCCAACCACGACTTCTTCGTGTTCTGGGGCCAGGG<br>CACCCTGGTGACAGTGAGCAGCGGAGGAGGCGGAAGCGGAGG<br>AGGAGGATCCGGAGGAGGAGGCAGCGACATCCAGATGACCCA<br>GTCCCCCTCCTCCCTGAGCGCCTCCGTGGGAGACAGGGTGACC<br>ATCACCTGCCAGGCCAGCCAGGACATCAGCAACTACCTGAACT<br>GGTACCAGCAGAAGCCCGGCAAGGCCCCCAAGCTGCTGATTTA<br>CTACACCAGCAGGCTGGAAACCGGCGTGCCCAGCAGATTTAGC<br>GGCAGCGGCAGCGGCACCGACTTTACCTTTACCATCTCCAGCC<br>TGCAGCCCGAGGATATCGCCACATACTACTGCCAGCAGGGCAA<br>CACCCTCCCCCCTACCTTTGGCGGCGGCACCAAGGTGGAGATT<br>AAGAGTGCTGCTGCCTTTGTCCCGGTATTTCTCCCAGCCAAACC<br>GACCACGACTCCCGCCCCGCGCCCTCCGACACCCGCTCCCACC<br>ATCGCCTCTCAACCTCTTAGTCTTCGCCCCGAGGCATGCCGACC<br>CGCCGCCGGGGGTGCTGTTCATACGAGGGGCTTGGACTTCGCT<br>TGTGATATTTACATTTGGGCTCCGTTGGCGGGTACGTGCGGCGT<br>CCTTTTGTTGTCACTCGTTATTACTTTGTATTGTAATCACAGGAA<br>TCGCTCAAAGCGGAGTAGGTTGTTGCATTCCGATTACATGAAT<br>ATGACTCCTCGCCGGCCTGGGCCGACAAGAAAACATTACCAAC<br>CCTATGCCCCCCACGAGACTTCGCTGCGTACAGGTCCCGAGT<br>GAAGTTTTCCCGAAGCGCAGACGCTCCGGCATATCAGCAAGGA<br>CAGAATCAGCTGTATAACGAACTGAATTTGGGACGCCGCGAGG<br>AGTATGACGTGCTTGATAAACGCCGGGGAGAGACCCGGAAA<br>TGGGGGGTAAACCCCGAAGAAAGAATCCCCAAGAAGGACTCT<br>ACAATGAACTCCAGAAGGATAAGATGGCGGAGGCCTACTCAG<br>AAATAGGTATGAAGGGCGAACGACGACGGGGAAAAGGTCACG<br>ATGGCCTCTACCAAGGGTTGAGTACGGCAACCAAAGATACGTA<br>CGATGCACTGCATATGCAGGCCCTGCCTCCCAGA |
| 1444 | Anti-BCMA<br>CAR of CTX-<br>175 | ATGGCGCTTCCGGTGACAGCACTGCTCCTCCCCTTGGCGCTGTT<br>GCTCCACGCAGCAAGGCCGCAGGTGCAGCTGGTGCAGTCCGGC<br>CCCGAACTGAAAAAGCCCGGCGCCAGCGTCAAGATCAGCTGCA<br>AGACCTCCGGCTACACCTTCACCGAGTACACCATCAACTGGGT<br>GAAGCAGGCCCCCGGCCAGGACTGGAATGGATTGGCGACAT<br>CTACCCCGACAACTACAACATTAGGTATAACCAGAAGTTCCAG<br>GGCAAGGCCACCATCACAAGAGACACCAGCAGCAGCACCGCC<br>TACATGGAGCTGAGCAGCCTGAGGAGCGAGGACACCGCCGTGT<br>ACTACTGCGCCAACCACGACTTCTTCGTGTTCTGGGGCCAGGG<br>AACCCTGGTGACAGTGTCCAGCGGCGGCGGCGGCTCCGGCGGC<br>GGCGGCTCCGGCGGCGGCGGCAGCGACATTCAGATGACACAG<br>AGCCCCTCCAGCCTGAGCGCCAGCCTGGGCGATAGGGTGACCA<br>TCACCTGCAGAACCAGCCAGGACATCAGCAACCACCTGAATTG<br>GTACCAGCAGAAGCCCGGAAAGGCCCCCAAACTGCTGATCTAC<br>TACACCAGCAGGCTGGAGAGCGGCGTGCCTAGCAGGTTTAGCG<br>GCAGCGGCAGCGGCACAGATTACAGCCTGACCATCAGCAGCCT<br>GCAGCCCGAAGACATCGGCACCTACTACTGCCAGCAGGGCAAC<br>ACCCTGCCCCCTACCTTTGGCGGAGGCACCAAGCTGGAGATCA<br>AGAGTGCTGCTGCCTTTGTCCCGGTATTTCTCCCAGCCAAACCG<br>ACCACGACTCCCGCCCCGCGCCCTCCGACACCCGCTCCCACCA<br>TCGCCTCTCAACCTCTTAGTCTTCGCCCCGAGGCATGCCGACCC<br>GCCGCCGGGGGTGCTGTTCATACGAGGGGCTTGGACTTCGCTT<br>GTGATATTTACATTTGGGCTCCGTTGGCGGGTACGTGCGGCGTC<br>CTTTTGTTGTCACTCGTTATTACTTTGTATTGTAATCACAGGAAT<br>CGCTCAAAGCGGAGTAGGTTGTTGCATTCCGATTACATGAATA<br>TGACTCCTCGCCGGCCTGGGCCGACAAGAAAACATTACCAACC<br>CTATGCCCCCCACGAGACTTCGCTGCGTACAGGTCCCGAGTG<br>AAGTTTTCCCGAAGCGCAGACGCTCCGGCATATCAGCAAGGAC<br>AGAATCAGCTGTATAACGAACTGAATTTGGGACGCCGCGAGGA<br>GTATGACGTGCTTGATAAACGCCGGGGAGAGACCCGGAAAT<br>GGGGGGTAAACCCCGAAGAAAGAATCCCCAAGAAGGACTCTA<br>CAATGAACTCCAGAAGGATAAGATGGCGGAGGCCTACTCAGA<br>AATAGGTATGAAGGGCGAACGACGACGGGGAAAAGGTCACGA<br>TGGCCTCTACCAAGGGTTGAGTACGGCAACCAAAGATACGTAC<br>GATGCACTGCATATGCAGGCCCTGCCTCCCAGA |
| 1445 | Anti-BCMA<br>CAR of CTX-<br>176 | ATGGCGCTTCCGGTGACAGCACTGCTCCTCCCCTTGGCGCTGTT<br>GCTCCACGCAGCAAGGCCGGACATCCAGATGACACAGAGCCCT<br>AGCAGCCTGAGCGCTTCCGTGGGCGACAGGGTGACCATCACCT<br>GCCAGGCCAGCCAGGACATCAGCAACTACCTCAACTGGTACCA<br>GCAGAAGCCCGGCAAGGCCCCTAAGCTGCTGATCTACTACACC<br>TCCAGGCTGGAGACCGGAGTGCCCTCCAGATTTTCCGGCAGCG<br>GCAGCGGCACCGATTTCACCTTCACCATCAGCAGCCTGCAGCC<br>CGAGGACATCGCCACCTACTATTGCCAGCAGGGCAACACCCTG<br>CCCCCCACATTTGGAGGCGGCACCAAGGTGGAGATCAAGGGCG<br>GAGGAGGAAGCGGAGGAGGAGGAAGCGGAGGAGGCGGAAGC<br>CAGGTGCAGCTGGTGCAGAGCGGCGCTGAGCTCAAGAAGCCTG |

TABLE 36-continued

CAR Nucleotide Sequences

| SEQ ID NO: | Description | Sequence |
|---|---|---|
| | | GCGCCAGCGTGAAGATCAGCTGCAAAGCCTCCGGATACACCTT
CACCGAGTACACCATCAATTGGGTGAGACAGGCCCCCGGCCAA
AGACTGGAGTGGATGGGCGACATCTATCCCGACAACTACAGCA
TCAGGTACAACCAGAAGTTCCAGGGCAGGGTGACAATCACCAG
AGACACCAGCGCCAGCACCGCCTACATGGAGCTGAGCAGCCTG
AGGAGCGAGGACACCGCCGTGTACTACTGCGCCAATCACGACT
TCTTCGTGTTCTGGGGCCAGGGAACCCTGGTGACCGTCAGCTCC
AGTGCTGCTGCCTTTGTCCCGGTATTTCTCCCAGCCAAACCGAC
CACGACTCCCGCCCCGCGCCCTCCGACACCCGCTCCCACCATC
GCCTCTCAACCTCTTAGTCTTCGCCCCGAGGCATGCCGACCCGC
CGCCGGGGGTGCTGTTCATACGAGGGGCTTGGACTTCGCTTGT
GATATTTACATTTGGGCTCCGTTGGCGGGTACGTGCGGCGTCCT
TTTGTTGTCACTCGTTATTACTTTGTATTGTAATCACAGGAATC
GCTCAAAGCGGAGTAGGTTGTTGCATTCCGATTACATGAATAT
GACTCCTCGCCGGCCTGGGCCGACAAGAAAACATTACCAACCC
TATGCCCCCCCACGAGACTTCGCTGCGTACAGGTCCCGAGTGA
AGTTTTCCCGAAGCGCAGACGCTCCGGCATATCAGCAAGGACA
GAATCAGCTGTATAACGAACTGAATTTGGGACGCCGCGAGGAG
TATGACGTGCTTGATAAACGCCGGGGGAGAGACCCGGAAATG
GGGGGTAAACCCCGAAGAAAGAATCCCCAAGAAGGACTCTAC
AATGAACTCCAGAAGGATAAGATGGCGGAGGCCTACTCAGAA
ATAGGTATGAAGGGCGAACGACGACGGGGAAAAGGTCACGAT
GGCCTCTACCAAGGGTTGAGTACGGCAACCAAAGATACGTACG
ATGCACTGCATATGCAGGCCCTGCCTCCCAGA |
| 1446 | Anti-BCMA
CAR of CTX-
177 | ATGGCGCTTCCGGTGACAGCACTGCTCCTCCCCTTGGCGCTGTT
GCTCCACGCAGCAAGGCCGGATATCCAGATGACACAGAGCCCT
AGCTCCCTGAGCGCCAGCCTGGGCGATAGGGTGACCATCACCT
GCAGGACCTCCCAGGACATCAGCAACCACCTGAACTGGTACCA
GCAGAAGCCCGGCAAAGCCCCCAAGCTGCTGATCTACTACACC
AGCAGGCTGGAAAGCGGCGTGCCCAGCAGGTTTAGCGGAAGC
GGCAGCGGCACCGACTACAGCCTGACCATCAGCTCCCTGCAGC
CCGAGGACATCGGCACCTACTACTGCCAGCAGGGCAACACCCT
GCCTCCCACCTTCGGAGGCGGAACCAAGCTGGAGATTAAGGGA
GGCGGCGAAGCGGCGGCGGCGGCTCCGGCGGAGGAGGCAGC
CAGGTGCAGCTGGTGCAGTCCGGAGCCGAGCTGAAAAAGCCTG
GCGCCAGCGTGAAGATCAGCTGCAAGGCCAGCGGCTACACCTT
CACCGAGTACACCATCAACTGGGTGAGGCAGGCCCCCTGGCCAG
AGACTCGAGTGGATGGGCGACATCTACCCCGACAACTACTCCA
TCAGGTACAACCAGAAGTTTCAGGGCAGGGTGACCATTACCAG
GGACACCAGCGCCAGCACAGCCTACATGGAGCTGAGCAGCCTG
AGGAGCGAGGATACAGCCTCTACTACTGCGCCAACCACGACT
TTTTCGTGTTCTGGGGACAGGGCACCCTGGTGACCGTGTCCTCC
AGTGCTGCTGCCTTTGTCCCGGTATTTCTCCCAGCCAAACCGAC
CACGACTCCCGCCCCGCGCCCTCCGACACCCGCTCCCACCATC
GCCTCTCAACCTCTTAGTCTTCGCCCCGAGGCATGCCGACCCGC
CGCCGGGGGTGCTGTTCATACGAGGGGCTTGGACTTCGCTTGT
GATATTTACATTTGGGCTCCGTTGGCGGGTACGTGCGGCGTCCT
TTTGTTGTCACTCGTTATTACTTTGTATTGTAATCACAGGAATC
GCTCAAAGCGGAGTAGGTTGTTGCATTCCGATTACATGAATAT
GACTCCTCGCCGGCCTGGGCCGACAAGAAAACATTACCAACCC
TATGCCCCCCCACGAGACTTCGCTGCGTACAGGTCCCGAGTGA
AGTTTTCCCGAAGCGCAGACGCTCCGGCATATCAGCAAGGACA
GAATCAGCTGTATAACGAACTGAATTTGGGACGCCGCGAGGAG
TATGACGTGCTTGATAAACGCCGGGGGAGAGACCCGGAAATG
GGGGGTAAACCCCGAAGAAAGAATCCCCAAGAAGGACTCTAC
AATGAACTCCAGAAGGATAAGATGGCGGAGGCCTACTCAGAA
ATAGGTATGAAGGGCGAACGACGACGGGGAAAAGGTCACGAT
GGCCTCTACCAAGGGTTGAGTACGGCAACCAAAGATACGTACG
ATGCACTGCATATGCAGGCCCTGCCTCCCAGA |
| 1447 | Anti-BCMA
CAR of CTX-
178 | ATGGCGCTTCCGGTGACAGCACTGCTCCTCCCCTTGGCGCTGTT
GCTCCACGCAGCAAGGCCGGACATCCAAATGACCCAGAGCCCT
AGCTCCCTGAGCGCTTCCGTGGGCGACAGAGTGACCATTACCT
GCCAGGCCAGCCAGGACATCAGCAACTACCTGAACTGGTATCA
GCAGAAGCCTGGCAAGGCCCCCAAGCTGCTGATCTACTACACC
AGCAGGCTGGAGACCGGAGTGCCCAGCAGGTTTAGCGGCTCCG
GATCCGGCACCGACTTCACCTTCACCATCTCCAGCCTGCAGCCC
GAGGACATCGCCACCTACTACTGCCAGCAGGGCAATACCCTCC
CCCCTACCTTCGGAGGCGGCACCAAGGTGGAGATCAAGGGCGG
CGGCGGCTCCGGCGGCGGCGGCAGCGGCGGAGGCGGCAGCCA
GGTGCAACTGGTGCAGAGCGGCCCTGAGCTGAAGAAACCCGG
CGCCAGCGTGAAAATCAGCTGCAAGACCAGCGGCTACACATTC
ACCGAGTACACCATCAACTGGGTGAAGCAGGCTCCCGGACAGG
GACTGGAGTGGATCGGCGACATCTACCCTGACAACTACAACAT
CAGATACAACCAAAAGTTCCAGGGCAAGGCCACCATCACCAG |

TABLE 36-continued

CAR Nucleotide Sequences

| SEQ ID NO: | Description | Sequence |
|---|---|---|
|  |  | GGACACCAGCTCCTCCACCGCCTACATGGAGCTGAGCAGCCTG<br>AGGAGCGAGGACACCGCTGTGTACTACTGCGCCAACCACGACT<br>TCTTCGTGTTCTGGGGCCAGGGAACCCTGGTGACCGTGAGCAG<br>CAGTGCTGCTGCCTTTGTCCCGGTATTTCTCCCAGCCAAACCGA<br>CCACGACTCCCGCCCCGCGCCCTCCGACACCCGCTCCCACCATC<br>GCCTCTCAACCTCTTAGTCTTCGCCCCGAGGCATGCCGACCCGC<br>CGCCGGGGGTGCTGTTCATACGAGGGGCTTGGACTTCGCTTGT<br>GATATTTACATTTGGGCTCCGTTGGCGGGTACGTGCGGCGTCCT<br>TTTGTTGTCACTCGTTATTACTTTGTATTGTAATCACAGGAATC<br>GCTCAAAGCGGAGTAGGTTGTTGCATTCCGATTACATGAATAT<br>GACTCCTCGCCGGCCTGGGCCGACAAGAAAACATTACCAACCC<br>TATGCCCCCCCACGAGACTTCGCTGCGTACAGGTCCCGAGTGA<br>AGTTTTCCCGAAGCGCAGACGCTCCGGCATATCAGCAAGGACA<br>GAATCAGCTGTATAACGAACTGAATTTGGGACGCCGCGAGGAG<br>TATGACGTGCTTGATAAACGCCGGGGAGAGACCCGGAAATG<br>GGGGGTAAACCCCGAAGAAAGAATCCCCAAGAAGGACTCTAC<br>AATGAACTCCAGAAGGATAAGATGGCGGAGGCCTACTCAGAA<br>ATAGGTATGAAGGGCGAACGACGACGGGGAAAAGGTCACGAT<br>GGCCTCTACCAAGGGTTGAGTACGGCAACCAAAGATACGTACG<br>ATGCACTGCATATGCAGGCCCTGCCTCCCAGA |
| 1448 | Anti-BCMA CAR of CTX-179 | ATGGCGCTTCCGGTGACAGCACTGCTCCTCCCCTTGGCGCTGTT<br>GCTCCACGCAGCAAGGCCGGATATCCAGATGACACAAAGCCCC<br>AGCAGCCTGTCCGCTAGCCTGGGCGATAGGGTGACCATCACAT<br>GCAGGACCAGCCAGGACATCTCCAACCACCTGAACTGGTACCA<br>GCAGAAGCCTGGAAAGGCCCCCAAACTGCTGATCTACTACACC<br>AGCAGGCTGGAGAGCGGCGTGCCTAGCAGGTTTTCCGGCAGCG<br>GCAGCGGCACCGACTATAGCCTGACCATCAGCTCCCTGCAGCC<br>CGAGGACATCGGCACCTACTACTGCCAGCAGGGAAACACACTG<br>CCCCCCACCTTTGGCGGCGGCACAAAGCTGGAGATCAAGGGCG<br>GCGGCGGATCCGGCGGCGGAGGCAGCGGAGGAGGAGGAAGCC<br>AGGTGCAGCTGGTGCAGTCCGGCCCTGAGCTGAAGAAGCCCGG<br>AGCCAGCGTGAAAATTAGCTGCAAGACCTCCGGCTACACATTC<br>ACCGAGTACACCATCAACTGGGTGAAGCAGGCTCCCGGCCAGG<br>GACTGGAGTGGATCGGCGACATCTACCCCGACAACTACAACAT<br>CAGGTACAACCAGAAATTCCAGGGCAAGGCCACCATCACCAG<br>GGACACCAGCTCCTCCACCGCCTATATGGAGCTGTCCAGCCTG<br>AGAAGCGAGGATACCGCCGTGTACTACTGCGCCAACCACGATT<br>TCTTCGTGTTCTGGGGCCAGGGCACACTGGTCACCGTGAGCAG<br>CAGTGCTGCTGCCTTTGTCCCGGTATTTCTCCCAGCCAAACCGA<br>CCACGACTCCCGCCCCGCGCCCTCCGACACCCGCTCCCACCATC<br>GCCTCTCAACCTCTTAGTCTTCGCCCCGAGGCATGCCGACCCGC<br>CGCCGGGGGTGCTGTTCATACGAGGGGCTTGGACTTCGCTTGT<br>GATATTTACATTTGGGCTCCGTTGGCGGGTACGTGCGGCGTCCT<br>TTTGTTGTCACTCGTTATTACTTTGTATTGTAATCACAGGAATC<br>GCTCAAAGCGGAGTAGGTTGTTGCATTCCGATTACATGAATAT<br>GACTCCTCGCCGGCCTGGGCCGACAAGAAAACATTACCAACCC<br>TATGCCCCCCCACGAGACTTCGCTGCGTACAGGTCCCGAGTGA<br>AGTTTTCCCGAAGCGCAGACGCTCCGGCATATCAGCAAGGACA<br>GAATCAGCTGTATAACGAACTGAATTTGGGACGCCGCGAGGAG<br>TATGACGTGCTTGATAAACGCCGGGGAGAGACCCGGAAATG<br>GGGGGTAAACCCCGAAGAAAGAATCCCCAAGAAGGACTCTAC<br>AATGAACTCCAGAAGGATAAGATGGCGGAGGCCTACTCAGAA<br>ATAGGTATGAAGGGCGAACGACGACGGGGAAAAGGTCACGAT<br>GGCCTCTACCAAGGGTTGAGTACGGCAACCAAAGATACGTACG<br>ATGCACTGCATATGCAGGCCCTGCCTCCCAGA |

TABLE 37

CAR Amino Acid Sequenes

| SEQ ID NO: | Description | Sequence |
|---|---|---|
| 1338 | Anti-CD19 CAR of CTX-131 to CTX-141 | MLLLVTSLLLCELPHPAFLLIPDIQMTQTTSSLSASLGDRVTISCRA<br>SQDISKYLNWYQQKPDGTVKLLIYHTSRLHSGVPSRFSGSGSGTD<br>YSLTISNLEQEDIATYFCQQGNTLPYTFGGGTKLEITGSTSGSGKPG<br>SGEGSTKGEVKLQESGPGLVAPSQSLSVTCTVSGVSLPDYGVSWI<br>RQPPRKGLEWLGVIWGSETTYYNSALKSRLTIIKDNSKSQVFLKM<br>NSLQTDDTAIYYCAKHYYYGGSYAMDYWGQGTSVTVSSAAAFV<br>PVFLPAKPTTTPAPRPPTPAPTIASQPLSLRPEACRPAAGGAVHTRG<br>LDFACDIYIWAPLAGTCGVLLLSLVITLYCNHRNRSKRSRLLHSDY<br>MNMTPRRPGPTRKHYQPYAPPRDFAAYRSRVKFSRSADAPAYQQ |

TABLE 37-continued

CAR Amino Acid Sequenes

| SEQ ID NO: | Description | Sequence |
|---|---|---|
| | | GQNQLYNELNLGRREEYDVLDKRRGRDPEMGGKPRRKNPQEGL YNELQKDKMAEAYSEIGMKGERRRGKGHDGLYQGLSTATKDTY DALHMQALPPR |
| 1449 | Anti-CD70A CAR of CTX-142 | MALPVTALLLPLALLLHAARPDIVMTQSPDSLAVSLGERATINCR ASKSVSTSGYSFMHWYQQKPGQPPKLLIYLASNLESGVPDRFSGS GSGTDFTLTISSLQAEDVAVYYCQHSREVPWTFGQGTKVEIKGGG GSGGGGSGGGGSGQVQLVQSGAEVKKPGASVKVSCKASGYTFTN YGMNWVRQAPGQGLKWMGWINTYTGEPTYADAFKGRVTMTRD TSISTAYMELSRLRSDDTAVYYCARDYGDYGMDYWGQGTTVTV SSSAAAFVPVFLPAKPTTTPAPRPPTPAPTIASQPLSLRPEACRPAA GGAVHTRGLDFACDIYIWAPLAGTCGVLLLSLVITLYCNHRNRSK RSRLLHSDYMNMTPRRPGPTRKHYQPYAPPRDFAAYRSRVKFSRS ADAPAYQQGQNQLYNELNLGRREEYDVLDKRRGRDPEMGGKPR RKNPQEGLYNELQKDKMAEAYSEIGMKGERRRGKGHDGLYQGL STATKDTYDALHMQALPPR |
| 1450 | Anti-CD70B CAR of CTX-145 | MALPVTALLLPLALLLHAARPQVQLVQSGAEVKKPGASVKVSCK ASGYTFTNYGMNWVRQAPGQGLKWMGWINTYTGEPTYADAFK GRVTMTRDTSISTAYMELSRLRSDDTAVYYCARDYGDYGMDYW GQGTTVTVSSGGGGSGGGGSGGGGSGDIVMTQSPDSLAVSLGER ATINCRASKSVSTSGYSFMHWYQQKPGQPPKLLIYLASNLESGVP DRFSGSGSGTDFTLTISSLQAEDVAVYYCQHSREVPWTFGQGTKV EIKSAAAFVPVFLPAKPTTTPAPRPPTPAPTIASQPLSLRPEACRPAA GGAVHTRGLDFACDIYIWAPLAGTCGVLLLSLVITLYCNHRNRSK RSRLLHSDYMNMTPRRPGPTRKHYQPYAPPRDFAAYRSRVKFSRS ADAPAYQQGQNQLYNELNLGRREEYDVLDKRRGRDPEMGGKPR RKNPQEGLYNELQKDKMAEAYSEIGMKGERRRGKGHDGLYQGL STATKDTYDALHMQALPPR |
| 1276 | Anti-CD70 CAR of CTX-145b | MALPVTALLLPLALLLHAARPQVQLVQSGAEVKKPGASVKVSCK ASGYTFTNYGMNWVRQAPGQGLKWMGWINTYTGEPTYADAFK GRVTMTRDTSISTAYMELSRLRSDDTAVYYCARDYGDYGMDYW GQGTTVTVSSGGGGSGGGGSGGGGSGDIVMTQSPDSLAVSLGER ATINCRASKSVSTSGYSFMHWYQQKPGQPPKLLIYLASNLESGVP DRFSGSGSGTDFTLTISSLQAEDVAVYYCQHSREVPWTFGQGTKV EIKSAAAFVPVFLPAKPTTTPAPRPPTPAPTIASQPLSLRPEACRPAA GGAVHTRGLDFACDIYIWAPLAGTCGVLLLSLVITLYCNHRNRKR GRKKLLYIFKQPFMRPVQTTQEEDGCSCRFPEEEEGGCELRVKFSR SADAPAYQQGQNQLYNELNLGRREEYDVLDKRRGRDPEMGGKP RRKNPQEGLYNELQKDKMAEAYSEIGMKGERRRGKGHDGLYQG LSTATKDTYDALHMQALPPR |
| 1451 | Anti-BCMA-1 CAR of CTX 152 and CTX-153 | MALPVTALLLPLALLLHAARPQVQLQQSGGGLVQPGGSLKLSCA ASGIDFSRYWMSWVRRAPGKGLEWIGEINPDSSTINYAPSLKDKFI ISRDNAKNTLYLQMSKVRSEDTALYYCASLYYDYGDAMDYWGQ GTSVTVSSGGGGSGGGGSGGGGSGDIVMTQSQRFMTTSVGDRVS VTCKASQSVDSNVAWYQQKPRQSPKALIFSASLRFSGVPARFTGS GSGTDFTLTISNLQSEDLAEYFCQQYNNYPLTFGAGTKLELKSAA AFVPVFLPAKPTTTPAPRPPTPAPTIASQPLSLRPEACRPAAGGAVH TRGLDFACDIYIWAPLAGTCGVLLLSLVITLYCNHRNRSKRSLLH SDYMNMTPRRPGPTRKHYQPYAPPRDFAAYRSRVKFSRSADAPA YQQGQNQLYNELNLGRREEYDVLDKRRGRDPEMGGKPRRKNPQ EGLYNELQKDKMAEAYSEIGMKGERRRGKGHDGLYQGLSTATK DTYDALHMQALPPR |
| 1452 | Anti-BCMA-2 CAR of CTX-154 and CTX-155 | MALPVTALLLPLALLLHAARPDIVMTQSQRFMTTSVGDRVSVTCK ASQSVDSNVAWYQQKPRQSPKALIFSASLRFSGVPARFTGSGSGT DFTLTISNLQSEDLAEYFCQQYNNYPLTFGAGTKLELKGGGGSGG GGSGGGGSGQVQLQQSGGGLVQPGGSLKLSCAASGIDFSRYWMS WVRRAPGKGLEWIGEINPDSSTINYAPSLKDKFIISRDNAKNTLYL QMSKVRSEDTALYYCASLYYDYGDAMDYWGQGTSVTVSSSAAA FVPVFLPAKPTTTPAPRPPTPAPTIASQPLSLRPEACRPAAGGAVHT RGLDFACDIYIWAPLAGTCGVLLLSLVITLYCNHRNRSKRSLLHS DYMNMTPRRPGPTRKHYQPYAPPRDFAAYRSRVKFSRSADAPAY QQGQNQLYNELNLGRREEYDVLDKRRGRDPEMGGKPRRKNPQE GLYNELQKDKMAEAYSEIGMKGERRRGKGHDGLYQGLSTATKD TYDALHMQALPPR |
| 1453 | Anti-BCMA CAR of CTX-160 and CTX-160b | MALPVTALLLPLALLLHAARPEVQLVESGGGLVQPGGSLKLSCAA SGIDFSRYWMSWVRQAPGKGLEWIGEINPDSSTINYADSVKGRFTI SRDNAKNTLYLQMNLSRAEDTALYYCASLYYDYGDAMDYWGQ GTLVTVSSGGGGSGGGGSGGGGSDIQMTQSPSSLSASVGDRVTIT CRASQSVDSNVAWYQQKPEKAPKSLIFSASLRFSGVPSRFSGSGS TDFTLTISSLQPEDFATYYCQQYNSYPLTFGAGTKLEIKSAAAFVP |

TABLE 37-continued

CAR Amino Acid Sequences

| SEQ ID NO: | Description | Sequence |
|---|---|---|
| | | VFLPAKPTTTPAPRPPTPAPTIASQPLSLRPEACRPAAGGAVHTRGL<br>DFACDIYIWAPLAGTCGVLLLSLVITLYCNHRNRSKRSRLLHSDY<br>MNMTPRRPGPTRKHYQPYAPPRDFAAYRSVKFSRSADAPAYQQ<br>GQNQLYNELNLGRREEYDVLDKRRGRDPEMGGKPRRKNPQEGL<br>YNELQKDKMAEAYSEIGMKGERRRGKGHDGLYQGLSTATKDTY<br>DALHMQALPPR |
| 1454 | Anti-BCMA CAR of CTX-160b | MALPVTALLLPLALLLHAARPEVQLVESGGGLVQPGGSLKLSCAA<br>SGIDFSRYWMSWVRQAPGKGLEWIGEINPDSSTINYADSVKGRFTI<br>SRDNAKNTLYLQMNLSRAEDTALYYCASLYYDYGDAMDYWGQ<br>GTLVTVSSGGGGSGGGGSGGGGSDIQMTQSPSSLSASVGDRVTIT<br>CRASQSVDSNVAWYQQKPEKAPKSLIFSASLRFSGVPSRFSGSGSG<br>TDFTLTISSLQPEDFATYYCQQYNSYPLTFGAGTKLEIKSAAAFVP<br>VFLPAKPTTTPAPRPPTPAPTIASQPLSLRPEACRPAAGGAVHTRGL<br>DFACDIYIWAPLAGTCGVLLLSLVITLYCNHRNRKRGRKKLLYIFK<br>QPFMRPVQTTQEEDGCSCRFPEEEEGGCELRVKFSRSADAPAYQQ<br>GQNQLYNELNLGRREEYDVLDKRRGRDPEMGGKPRRKNPQEGL<br>YNELQKDKMAEAYSEIGMKGERRRGKGHDGLYQGLSTATKDTY<br>DALHMQALPPR |
| 1455 | Anti-BCMA CAR of CTX-161 | MALPVTALLLPLALLLHAARPEVQLVESGGGLVQPGGSLKLSCAA<br>SGIDFSRYWMSWVRQAPGKGLEWIGEINPDSSTINYADSVKGRFTI<br>SRDNAKNTLYLQMNLSRAEDTALYYCASLYYDYGDAMDYWGQ<br>GTLVTVSSGGGGSGGGGSGGGGSDIQMTQSPSSLSASPGDRVSVT<br>CKASQSVDSNVAWYQQKPRQAPKALIFSASLRFSGVPARFTGSGS<br>GTDFTLTISNLQSEDFATYYCQQYNNYPLTFGAGTKLEIKSAAAFV<br>PVFLPAKPTTTPAPRPPTPAPTIASQPLSLRPEACRPAAGGAVHTRG<br>LDFACDIYIWAPLAGTCGVLLLSLVITLYCNHRNRSKRSRLLHSDY<br>MNMTPRRPGPTRKHYQPYAPPRDFAAYRSVKFSRSADAPAYQQ<br>GQNQLYNELNLGRREEYDVLDKRRGRDPEMGGKPRRKNPQEGL<br>YNELQKDKMAEAYSEIGMKGERRRGKGHDGLYQGLSTATKDTY<br>DALHMQALPPR |
| 1456 | Anti-BCMA CAR of CTX-162 | MALPVTALLLPLALLLHAARPDIQMTQSPSSLSASVGDRVTITCRA<br>SQSVDSNVAWYQQKPEKAPKSLIFSASLRFSGVPSRFSGSGSGTDF<br>TLTISSLQPEDFATYYCQQYNSYPLTFGAGTKLEIKGGGGSGGGGS<br>GGGGSEVQLVESGGGLVQPGGSLKLSCAASGIDFSRYWMSWVRQ<br>APGKGLEWIGEINPDSSTINYADSVKGRFTISRDNAKNTLYLQMNL<br>SRAEDTALYYCASLYYDYGDAMDYWGQGTLVTVSSSAAAFVPV<br>FLPAKPTTTPAPRPPTPAPTIASQPLSLRPEACRPAAGGAVHTRGLD<br>FACDIYIWAPLAGTCGVLLLSLVITLYCNHRNRSKRSRLLHSDYM<br>NMTPRRPGPTRKHYQPYAPPRDFAAYRSVKFSRSADAPAYQQG<br>QNQLYNELNLGRREEYDVLDKRRGRDPEMGGKPRRKNPQEGLY<br>NELQKDKMAEAYSEIGMKGERRRGKGHDGLYQGLSTATKDTYD<br>ALHMQALPPR |
| 1457 | Anti-BCMA CAR of CTX-163 | MALPVTALLLPLALLLHAARPDIQMTQSPSSLSASPGDRVSVTCK<br>ASQSVDSNVAWYQQKPRQAPKALIFSASLRFSGVPARFTGSGSGT<br>DFTLTISNLQSEDFATYYCQQYNNYPLTFGAGTKLEIKGGGGSGG<br>GGSGGGGSEVQLVESGGGLVQPGGSLKLSCAASGIDFSRYWMSW<br>VRQAPGKGLEWIGEINPDSSTINYADSVKGRFTISRDNAKNTLYLQ<br>MNLSRAEDTALYYCASLYYDYGDAMDYWGQGTLVTVSSSAAAF<br>VPVFLPAKPTTTPAPRPPTPAPTIASQPLSLRPEACRPAAGGAVHTR<br>GLDFACDIYIWAPLAGTCGVLLLSLVITLYCNHRNRSKRSRLLHSD<br>YMNMTPRRPGPTRKHYQPYAPPRDFAAYRSVKFSRSADAPAYQ<br>QGQNQLYNELNLGRREEYDVLDKRRGRDPEMGGKPRRKNPQEG<br>LYNELQKDKMAEAYSEIGMKGERRRGKGHDGLYQGLSTATKDT<br>YDALHMQALPPR |
| 1458 | Anti-BCMA CAR of CTX-164 | MALPVTALLLPLALLLHAARPEVQLQQSGPELVKPGASVKMSCK<br>ASGNTLTNYVIHWMKQMPGQGLDWIGYILPYNDLTKYNEKFTGK<br>ATLTSDKSSSSAYMELNSLTSEDSAVYYCTRWDWDGFFDPWGQG<br>TTLTVSSGGGGSGGGGSGGGGSDIVMTQSPLSLPVSLGDQASISCR<br>STQSLVHSNGNTHLHWYLQRPGQSPKLLIYSVSNRFSEVPDRFSAS<br>GSGTDFTLKISRVEAEDLGVYFCSQTSHIPYTFGGGTKLEIKSAAAF<br>VPVFLPAKPTTTPAPRPPTPAPTIASQPLSLRPEACRPAAGGAVHTR<br>GLDFACDIYIWAPLAGTCGVLLLSLVITLYCNHRNRSKRSRLLHSD<br>YMNMTPRRPGPTRKHYQPYAPPRDFAAYRSVKFSRSADAPAYQ<br>QGQNQLYNELNLGRREEYDVLDKRRGRDPEMGGKPRRKNPQEG<br>LYNELQKDKMAEAYSEIGMKGERRRGKGHDGLYQGLSTATKDT<br>YDALHMQALPPR |
| 1459 | Anti-BCMA CAR of CTX-165 | MALPVTALLLPLALLLHAARPDIVMTQSPLSLPVSLGDQASISCRS<br>TQSLVHSNGNTHLHWYLQRPGQSPKLLIYSVSNRFSEVPDRFSAS<br>GSGTDFTLKISRVEAEDLGVYFCSQTSHIPYTFGGGTKLEIKGGGG |

TABLE 37-continued

CAR Amino Acid Sequenes

| SEQ ID NO: | Description | Sequence |
|---|---|---|
| | | SGGGGSGGGGSEVQLQQSGPELVKPGASVKMSCKASGNTLTNYV
IHWMKQMPGQGLDWIGYILPYNDLTKYNEKFTGKATLTSDKSSSS
AYMELNSLTSEDSAVYYCTRWDWDGFFDPWGQGTTLTVSSSAA
AFVPVFLPAKPTTTPAPRPPTPAPTIASQPLSLRPEACRPAAGGAVH
TRGLDFACDIYIWAPLAGTCGVLLLSLVITLYCNHRNRSKRSRLLH
SDYMNMTPRRPGPTRKHYQPYAPPRDFAAYRSRVKFSRSADAPA
YQQGQNQLYNELNLGRREEYDVLDKRRGRDPEMGGKPRRKNPQ
EGLYNELQKDKMAEAYSEIGMKGERRRGKGHDGLYQGLSTATK
DTYDALHMQALPPR |
| 1460 | Anti-BCMA CAR of CTX-166 | MALPVTALLLPLALLLHAARPQVQLVQSGAELKKPGASVKVSCK
ASGNTLTNYVIHWVRQAPGQRLEWMGYILPYNDLTKYSQKFQGR
VTITRDKSASTAYMELSSLRSEDTAVYYCTRWDWDGFFDPWGQG
TTVTVSSGGGGSGGGGSGGGGSEIVMTQSPATLSVSPGERASISCR
ASQSLVHSNGNTHLHWYQQRPGQAPRLLIYSVSNRFSEVPARFSG
SGSGTDFTLTISSVESEDFAVYYCSQTSHIPYTFGGGTKLEIKSAAA
FVPVFLPAKPTTTPAPRPPTPAPTIASQPLSLRPEACRPAAGGAVHT
RGLDFACDIYIWAPLAGTCGVLLLSLVITLYCNHRNRSKRSRLLHS
DYMNMTPRRPGPTRKHYQPYAPPRDFAAYRSRVKFSRSADAPAY
QQGQNQLYNELNLGRREEYDVLDKRRGRDPEMGGKPRRKNPQE
GLYNELQKDKMAEAYSEIGMKGERRRGKGHDGLYQGLSTATKD
TYDALHMQALPPR |
| 1461 | Anti-BCMA CAR of CTX-166b | MALPVTALLLPLALLLHAARPQVQLVQSGAELKKPGASVKVSCK
ASGNTLTNYVIHWVRQAPGQRLEWMGYILPYNDLTKYSQKFQGR
VTITRDKSASTAYMELSSLRSEDTAVYYCTRWDWDGFFDPWGQG
TTVTVSSGGGGSGGGGSGGGGSEIVMTQSPATLSVSPGERASISCR
ASQSLVHSNGNTHLHWYQQRPGQAPRLLIYSVSNRFSEVPARFSG
SGSGTDFTLTISSVESEDFAVYYCSQTSHIPYTFGGGTKLEIKSAAA
FVPVFLPAKPTTTPAPRPPTPAPTIASQPLSLRPEACRPAAGGAVHT
RGLDFACDIYIWAPLAGTCGVLLLSLVITLYCNHRNRKRGRKKLL
YIFKQPFMRPVQTTQEEDGCSCRFPEEEEGGCELRVKFSRSADAPA
YQQGQNQLYNELNLGRREEYDVLDKRRGRDPEMGGKPRRKNPQ
EGLYNELQKDKMAEAYSEIGMKGERRRGKGHDGLYQGLSTATK
DTYDALHMQALPPR |
| 1462 | Anti-BCMA CAR of CTX-167 | MALPVTALLLPLALLLHAARPQVQLVQSGAELKKPGASVKVSCK
ASGNTLTNYVIHWVRQAPGQRLEWMGYILPYNDLTKYSQKFQGR
VTITRDKSASTAYMELSSLRSEDTAVYYCTRWDWDGFFDPWGQG
TTVTVSSGGGGSGGGGSGGGGSDIVMTQSPLSLPVTLGQPATLSC
RSTQSLVHSNGNTHLHWFQQRPGQSPLRLIYSVSNRDSGVPDRFS
GSGSGTDFTLKISRVEAEDVGVYYCSQTSHIPYTFGGGTKLEIKSA
AAFVPVFLPAKPTTTPAPRPPTPAPTIASQPLSLRPEACRPAAGGAV
HTRGLDFACDIYIWAPLAGTCGVLLLSLVITLYCNHRNRSKRSRLL
HSDYMNMTPRRPGPTRKHYQPYAPPRDFAAYRSRVKFSRSADAP
AYQQGQNQLYNELNLGRREEYDVLDKRRGRDPEMGGKPRRKNP
QEGLYNELQKDKMAEAYSEIGMKGERRRGKGHDGLYQGLSTAT
KDTYDALHMQALPPR |
| 1463 | Anti-BCMA CAR of CTX-168 | MALPVTALLLPLALLLHAARPEIVMTQSPATLSVSPGERASISCRA
SQSLVHSNGNTHLHWYQQRPGQAPRLLIYSVSNRFSEVPARFSGS
GSGTDFTLTISSVESEDFAVYYCSQTSHIPYTFGGGTKLEIKGGGGS
GGGGSGGGGSQVQLVQSGAELKKPGASVKVSCKASGNTLTNYVI
HWVRQAPGQRLEWMGYILPYNDLTKYSQKFQGRVTITRDKSAST
AYMELSSLRSEDTAVYYCTRWDWDGFFDPWGQGTTVTVSSSAA
AFVPVFLPAKPTTTPAPRPPTPAPTIASQPLSLRPEACRPAAGGAVH
TRGLDFACDIYIWAPLAGTCGVLLLSLVITLYCNHRNRSKRSRLLH
SDYMNMTPRRPGPTRKHYQPYAPPRDFAAYRSRVKFSRSADAPA
YQQGQNQLYNELNLGRREEYDVLDKRRGRDPEMGGKPRRKNPQ
EGLYNELQKDKMAEAYSEIGMKGERRRGKGHDGLYQGLSTATK
DTYDALHMQALPPR |
| 1464 | Anti-BCMA CAR of CTX-169 | MALPVTALLLPLALLLHAARPDIVMTQSPLSLPVTLGQPATLSCRS
TQSLVHSNGNTHLHWFQQRPGQSPLRLIYSVSNRDSGVPDRFSGS
GSGTDFTLKISRVEAEDVGVYYCSQTSHIPYTFGGGTKLEIKGGGG
SGGGGSGGGGSQVQLVQSGAELKKPGASVKVSCKASGNTLTNYV
IHWVRQAPGQRLEWMGYILPYNDLTKYSQKFQGRVTITRDKSAS
TAYMELSSLRSEDTAVYYCTRWDWDGFFDPWGQGTTVTVSSSA
AAFVPVFLPAKPTTTPAPRPPTPAPTIASQPLSLRPEACRPAAGGAV
HTRGLDFACDIYIWAPLAGTCGVLLLSLVITLYCNHRNRSKRSRLL
HSDYMNMTPRRPGPTRKHYQPYAPPRDFAAYRSRVKFSRSADAP
AYQQGQNQLYNELNLGRREEYDVLDKRRGRDPEMGGKPRRKNP
QEGLYNELQKDKMAEAYSEIGMKGERRRGKGHDGLYQGLSTAT
KDTYDALHMQALPPR |

TABLE 37-continued

CAR Amino Acid Sequenes

| SEQ ID NO: | Description | Sequence |
|---|---|---|
| 1465 | Anti-BCMA CAR of CTX-170 | MALPVTALLLPLALLLHAARPEVQLQQSGPELVKPGASVKISCKT SGYTFTEYTINWVKQSHGKSLEWIGDIYPDNYNIRYNQKFKGKAT LTVDKSSSTAYMELRSLSSEDSAIYYCANHDFFVFWGQGTLVTVS AGGGGSGGGGSGGGGSDIQMTQATSSLSASLGDRVTINCRTSQDI SNHLNWYQQKPDGTVKLLIYYTSRLQSGVPSRFSGSGSGTDYSLTI SNLEQEDIGTYFCHQGNTLPPTFGGGTKLEIKSAAAFVPVFLPAKP TTTPAPRPPTPAPTIASQPLSLRPEACRPAAGGAVHTRGLDFACDIY IWAPLAGTCGVLLLSLVITLYCNHRNRSKRSRLLHSDYMNMTPRR PGPTRKHYQPYAPPRDFAAYRSRVKFSRSADAPAYQQGQNQLYN ELNLGRREEYDVLDKRRGRDPEMGGKPRRKNPQEGLYNELQKD KMAEAYSEIGMKGERRRGKGHDGLYQGLSTATKDTYDALHMQA LPPR |
| 1466 | Anti-BCMA CAR of CTX-171 | MALPVTALLLPLALLLHAARPDIQMTQATSSLSASLGDRVTINCRT SQDISNHLNWYQQKPDGTVKLLIYYTSRLQSGVPSRFSGSGSGTD YSLTISNLEQEDIGTYFCHQGNTLPPTFGGGTKLEIKGGGGSGGGG SGGGGSEVQLQQSGPELVKPGASVKISCKTSGYTFTEYTINWVKQ SHGKSLEWIGDIYPDNYNIRYNQKFKGKATLTVDKSSSTAYMELR SLSSEDSAIYYCANHDFFVFWGQGTLVTVSASAAAFVPVFLPAKP TTTPAPRPPTPAPTIASQPLSLRPEACRPAAGGAVHTRGLDFACDIY IWAPLAGTCGVLLLSLVITLYCNHRNRSKRSRLLHSDYMNMTPRR PGPTRKHYQPYAPPRDFAAYRSRVKFSRSADAPAYQQGQNQLYN ELNLGRREEYDVLDKRRGRDPEMGGKPRRKNPQEGLYNELQKD KMAEAYSEIGMKGERRRGKGHDGLYQGLSTATKDTYDALHMQA LPPR |
| 1467 | Anti-BCMA CAR of CTX-172 | MALPVTALLLPLALLLHAARPQVQLVQSGAELKKPGASVKISCKA SGYTFTEYTINWVRQAPGQRLEWMGDIYPDNYSIRYNQKFQGRV TITRDTSASTAYMELSSLRSEDTAVYYCANHDFFVFWGQGTLVTV SSGGGGSGGGGSGGGGSDIQMTQSPSSLSASVGDRVTITCQASQDI SNYLNWYQQKPGKAPKLLIYYTSRLETGVPSRFSGSGSGTDFTFTI SSLQPEDIATYYCQQGNTLPPTFGGGTKVEIKSAAAFVPVFLPAKP TTTPAPRPPTPAPTIASQPLSLRPEACRPAAGGAVHTRGLDFACDIY IWAPLAGTCGVLLLSLVITLYCNHRNRSKRSRLLHSDYMNMTPRR PGPTRKHYQPYAPPRDFAAYRSRVKFSRSADAPAYQQGQNQLYN ELNLGRREEYDVLDKRRGRDPEMGGKPRRKNPQEGLYNELQKD KMAEAYSEIGMKGERRRGKGHDGLYQGLSTATKDTYDALHMQA LPPR |
| 1468 | Anti-BCMA CAR of CTX-173 | MALPVTALLLPLALLLHAARPQVQLVQSGAELKKPGASVKISCKA SGYTFTEYTINWVRQAPGQRLEWMGDIYPDNYSIRYNQKFQGRV TITRDTSASTAYMELSSLRSEDTAVYYCANHDFFVFWGQGTLVTV SSGGGGSGGGGSGGGGSDIQMTQSPSSLSASLGDRVTITCRTSQDI SNHLNWYQQKPGKAPKLLIYYTSRLESGVPSRFSGSGSGTDYSLTI SSLQPEDIGTYYCQQGNTLPPTFGGGTKLEIKSAAAFVPVFLPAKP TTTPAPRPPTPAPTIASQPLSLRPEACRPAAGGAVHTRGLDFACDIY IWAPLAGTCGVLLLSLVITLYCNHRNRSKRSRLLHSDYMNMTPRR PGPTRKHYQPYAPPRDFAAYRSRVKFSRSADAPAYQQGQNQLYN ELNLGRREEYDVLDKRRGRDPEMGGKPRRKNPQEGLYNELQKD KMAEAYSEIGMKGERRRGKGHDGLYQGLSTATKDTYDALHMQA LPPR |
| 1469 | Anti-BCMA CAR of CTX-174 | MALPVTALLLPLALLLHAARPQVQLVQSGPELKKPGASVKISCKT SGYTFTEYTINWVKQAPGQGLEWIGDIYPDNYNIRYNQKFQGKAT ITRDTSSSTAYMELSSLRSEDTAVYYCANHDFFVFWGQGTLVTVS SGGGGSGGGGSGGGGSDIQMTQSPSSLSASVGDRVTITCQASQDIS NYLNWYQQKPGKAPKLLIYYTSRLETGVPSRFSGSGSGTDFTFTIS SLQPEDIATYYCQQGNTLPPTFGGGTKVEIKSAAAFVPVFLPAKPT TTPAPRPPTPAPTIASQPLSLRPEACRPAAGGAVHTRGLDFACDIYI WAPLAGTCGVLLLSLVITLYCNHRNRSKRSRLLHSDYMNMTPRR PGPTRKHYQPYAPPRDFAAYRSRVKFSRSADAPAYQQGQNQLYN ELNLGRREEYDVLDKRRGRDPEMGGKPRRKNPQEGLYNELQKD KMAEAYSEIGMKGERRRGKGHDGLYQGLSTATKDTYDALHMQA LPPR |
| 1470 | Anti-BCMA CAR of CTX-175 | MALPVTALLLPLALLLHAARPQVQLVQSGPELKKPGASVKISCKT SGYTFTEYTINWVKQAPGQGLEWIGDIYPDNYNIRYNQKFQGKAT ITRDTSSSTAYMELSSLRSEDTAVYYCANHDFFVFWGQGTLVTVS SGGGGSGGGGSGGGGSDIQMTQSPSSLSASLGDRVTITCRTSQDIS NHLNWYQQKPGKAPKLLIYYTSRLESGVPSRFSGSGSGTDYSLTIS SLQPEDIGTYYCQQGNTLPPTFGGGTKLEIKSAAAFVPVFLPAKPT TTPAPRPPTPAPTIASQPLSLRPEACRPAAGGAVHTRGLDFACDIYI WAPLAGTCGVLLLSLVITLYCNHRNRSKRSRLLHSDYMNMTPRR PGPTRKHYQPYAPPRDFAAYRSRVKFSRSADAPAYQQGQNQLYN ELNLGRREEYDVLDKRRGRDPEMGGKPRRKNPQEGLYNELQKD |

TABLE 37-continued

CAR Amino Acid Sequenes

| SEQ ID NO: | Description | Sequence |
|---|---|---|
| | | KMAEAYSEIGMKGERRRGKGHDGLYQGLSTATKDTYDALHMQA LPPR |
| 1471 | Anti-BCMA CAR of CTX-176 | MALPVTALLLPLALLLHAARPDIQMTQSPSSLSASVGDRVTITCQA SQDISNYLNWYQQKPGKAPKLLIYYTSRLETGVPSRFSGSGSGTDF TFTISSLQPEDIATYYCQQGNTLPPTFGGGTKVEIKGGGGSGGGGS GGGGSQVQLVQSGAELKKPGASVKISCKASGYTFTEYTINWVRQ APGQRLEWMGDIYPDNYSIRYNQKFQGRVTITRDTSASTAYMELS SLRSEDTAVYYCANHDFFVFWGQGTLVTVSSSAAAFVPVFLPAKP TTTPAPRPPTPAPTIASQPLSLRPEACRPAAGGAVHTRGLDFACDIY IWAPLAGTCGVLLLSLVITLYCNHRNRSKRSRLLHSDYMNMTPRR PGPTRKHYQPYAPPRDFAAYRSRVKFSRSADAPAYQQGQNQLYN ELNLGRREEYDVLDKRRGRDPEMGGKPRRKNPQEGLYNELQKD KMAEAYSEIGMKGERRRGKGHDGLYQGLSTATKDTYDALHMQA LPPR |
| 1472 | Anti-BCMA CAR of CTX-177 | MALPVTALLLPLALLLHAARPDIQMTQSPSSLSASLGDRVTITCRT SQDISNHLNWYQQKPGKAPKLLIYYTSRLESGVPSRFSGSGSGTDY SLTISSLQPEDIGTYYCQQGNTLPPTFGGGTKLEIKGGGGSGGGGS GGGGSQVQLVQSGAELKKPGASVKISCKASGYTFTEYTINWVRQ APGQRLEWMGDIYPDNYSIRYNQKFQGRVTITRDTSASTAYMELS SLRSEDTAVYYCANHDFFVFWGQGTLVTVSSSAAAFVPVFLPAKP TTTPAPRPPTPAPTIASQPLSLRPEACRPAAGGAVHTRGLDFACDIY IWAPLAGTCGVLLLSLVITLYCNHRNRSKRSRLLHSDYMNMTPRR PGPTRKHYQPYAPPRDFAAYRSRVKFSRSADAPAYQQGQNQLYN ELNLGRREEYDVLDKRRGRDPEMGGKPRRKNPQEGLYNELQKD KMAEAYSEIGMKGERRRGKGHDGLYQGLSTATKDTYDALHMQA LPPR |
| 1473 | Anti-BCMA CAR of CTX-178 | MALPVTALLLPLALLLHAARPDIQMTQSPSSLSASVGDRVTITCQA SQDISNYLNWYQQKPGKAPKLLIYYTSRLETGVPSRFSGSGSGTDF TFTISSLQPEDIATYYCQQGNTLPPTFGGGTKVEIKGGGGSGGGGS GGGGSQVQLVQSGPELKKPGASVKISCKTSGYTFTEYTINWVKQA PGQGLEWIGDIYPDNYNIRYNQKFQGKATITRDTSSSTAYMELSSL RSEDTAVYYCANHDFFVFWGQGTLVTVSSSAAAFVPVFLPAKPTT TPAPRPPTPAPTIASQPLSLRPEACRPAAGGAVHTRGLDFACDIYIW APLAGTCGVLLLSLVITLYCNHRNRSKRSRLLHSDYMNMTPRRPG PTRKHYQPYAPPRDFAAYRSRVKFSRSADAPAYQQGQNQLYNEL NLGRREEYDVLDKRRGRDPEMGGKPRRKNPQEGLYNELQKDKM AEAYSEIGMKGERRRGKGHDGLYQGLSTATKDTYDALHMQALPP R |
| 1474 | Anti-BCMA CAR of CTX-179 | MALPVTALLLPLALLLHAARPDIQMTQSPSSLSASLGDRVTITCRT SQDISNHLNWYQQKPGKAPKLLIYYTSRLESGVPSRFSGSGSGTDY SLTISSLQPEDIGTYYCQQGNTLPPTFGGGTKLEIKGGGGSGGGGS GGGGSQVQLVQSGPELKKPGASVKISCKTSGYTFTEYTINWVKQA PGQGLEWIGDIYPDNYNIRYNQKFQGKATITRDTSSSTAYMELSSL RSEDTAVYYCANHDFFVFWGQGTLVTVSSSAAAFVPVFLPAKPTT TPAPRPPTPAPTIASQPLSLRPEACRPAAGGAVHTRGLDFACDIYIW APLAGTCGVLLLSLVITLYCNHRNRSKRSRLLHSDYMNMTPRRPG PTRKHYQPYAPPRDFAAYRSRVKFSRSADAPAYQQGQNQLYNEL NLGRREEYDVLDKRRGRDPEMGGKPRRKNPQEGLYNELQKDKM AEAYSEIGMKGERRRGKGHDGLYQGLSTATKDTYDALHMQALPP R |

TABLE 38 scFv Nucleotide Sequences

| SEQ ID NO: | Description | Sequence |
|---|---|---|
| 1333 | Anti-CD19 scFv of CTX-131 to CTX-141 | ATTCAGATGACTCAGACCACCAGTAGCTTGTCTGCCTCACTGG GAGACCGAGTAACAATCTCCTGCAGGGCAAGTCAAGACATTAG CAAATACCTCAATTGGTACCAGCAGAAGCCCGACGGAACGGTA AAACTCCTCATCTATCATACGTCAAGGTTGCATTCCGGAGTACC GTCACGATTTTCAGGTTCTGGGAGCGGAACTGACTATTCCTTGA CTATTTCAAACCTCGAGCAGGAGGACATTGCGACATATTTTTGT CAACAAGGTAATACCCTCCCTTACACTTTCGGAGGAGGAACCA AACTCGAAATTACCGGGTCCACCAGTGGCTCTGGGAAGCCTGG CAGTGGAGAAGGTTCCACTAAAGGCGAGGTGAAGCTCCAGGA GAGCGGCCCCGGTCTCGTTGCCCCAGTCAAAGCCTCTCTGTA |

TABLE 38-continued scFv Nucleotide Sequences

| SEQ ID NO: | Description | Sequence |
|---|---|---|
| | | ACGTGCACAGTGAGTGGTGTATCATTGCCTGATTATGGCGTCTC<br>CTGGATAAGGCAGCCCCCGCGAAAGGGTCTTGAATGGCTTGGG<br>GTAATATGGGGCTCAGAGACAACGTATTATAACTCCGCTCTCA<br>AAAGTCGCTTGACGATAATAAAAGATAACTCCAAGAGTCAAGT<br>TTTCCTTAAAATGAACAGTTTGCAGACTGACGTACCGCTATAT<br>ATTATTGTGCTAAACATTATTACTACGGCGGTAGTTACGCGATG<br>GATTATTGGGGCAGGGGACTTCTGTCACAGTCAGT |
| 1475 | Anti-CD70A scFv of CTX-142 | GATATAGTTATGACCCAATCACCCGATAGTCTTGCGGTAAGCC<br>TGGGGGAGCGAGCAACAATAAACTGTCGGGCATCAAAATCCGT<br>CAGTACAAGCGGGTATTCATTCATGCACTGGTATCAACAGAAA<br>CCCGGTCAGCCACCCAAGCTCCTGATTTATCTTGCGTCTAATCT<br>TGAGTCCGGCGTCCCAGACCGGTTTTCCGGCTCCGGGAGCGGC<br>ACGGATTTTACTCTTACTATTTCTAGCCTTCAGGCCGAAGATGT<br>GGCGGTATACTACTGCCAGCATTCAAGGGAAGTTCCTTGGACG<br>TTCGTCAGGGCACGAAAGTGGAAATTAAAGGCGGGGGGGGA<br>TCCGGCGGGGAGGGTCTGGAGGAGGTGGCAGTGGTCAGGTC<br>CAACTGGTGCAGTCCGGGCAGAGGTAAAAAAACCCGGCGCG<br>TCTGTTAAGGTTTCATGCAAGGCCAGTGGATATACTTTCACCAA<br>TTACGGAATGAACTGGGTGAGGCAGGCCCCTGGTCAAGGCCTG<br>AAATGGATGGGATGGATAAACACGTACACCGGTGAACCTACCT<br>ATGCCGATGCCTTTAAGGGTCGGGTTACGATGACGAGAGACAC<br>CTCCATATCAACAGCCTACATGGAGCTCAGCAGATTGAGGAGT<br>GACGATACGGCAGTCTATTACTGTGCAAGAGACTACGGCGATT<br>ATGGCATGGATTACTGGGGCCAGGGCACTACAGTAACCGTTTC<br>CAGC |
| 1476 | Anti-CD70B scFv of CTX-145 and CTX-145b | CAGGTCCAGTTGGTGCAAAGCGGGGCGGAGGTGAAAAAACCC<br>GGCGCTTCCGTGAAGGTGTCCTGTAAGGCGTCCGGTTATACGTT<br>CACGAACTACGGGATGAATTGGGTTCGCCAAGCGCCGGGGCAG<br>GGACTGAAATGGATGGGGTGGATAAATACCTACACCGGCGAA<br>CCTACATACGCCGACGCTTTTAAAGGGCGAGTCACTATGACGC<br>GCGATACCAGCATATCCACCGACATACATGGAGCTGTCCCGACT<br>CCGGTCAGACGACACGGCTGTCTACTATTGTGCTCGGGACTAT<br>GGCGATTATGGCATGGACTACTGGGGTCAGGGTACGACTGTAA<br>CAGTTAGTAGTGGTGGAGGCGGCAGTGGCGGGGGGGAAGCG<br>GAGGAGGGGGTTCTGGTGACATAGTTATGACCCAATCCCCAGA<br>TAGTTTGGCGGTTTCTCTGGGCGAGAGGGCAACGATTAATTGT<br>CGCGCATCAAAGAGCGTTTCAACGAGCGGATATTCTTTTATGC<br>ATTGGTACCAGCAAAAACCCGGACAACCGCCGAAGCTGCTGAT<br>CTACTTGGCTTCAAATCTTGAGTCTGGGGTGCCGGACCGATTTT<br>CTGGTAGTGGAAGCGGAACTGACTTTACGCTCACGATCAGTTC<br>ACTGCAGGCTGAGGATGTAGCGGTCTATTATTGCCAGCACAGT<br>AGAGAAGTCCCCTGGACCTTCGGTCAAGGCACGAAAGTAGAA<br>ATTAAA |
| 1477 | Anti-BCMA-1 scFv of CTX 152 and CTX-153 | CAGGTGCAGTTACAACAGTCAGGAGGAGGATTAGTGCAGCCA<br>GGAGGATCTCTGAAACTGTCTTGTGCCGCCAGCGGAATCGATT<br>TTAGCAGGTACTGGATGTCTTGGGTGAGAAGAGCCCCTGGAAA<br>AGGACTGGAGTGGATCGGCGAGATTAATCCTGATAGCAGCACC<br>ATCAACTATGCCCCTAGCCTGAAGGACAAGTTCATCATCAGCC<br>GGGACAATGCCAAGAACACCCTGTACCTGCAAATGAGCAAGGT<br>GAGGAGCGAGGATACAGCTCTGTACTACTGTGCCAGCCTGTAC<br>TACGATTACGGAGATGCTATGGACTATTGGGGCCAGGGAACAA<br>GCGTTACAGTGTCTTCTGGAGGAGGAGGATCCGGTGGTGGTGG<br>TTCAGGAGGTGGAGGTTCGGGAGATATTGTGATGACACAAAGC<br>CAGCGGTTCATGACCACATCTGTGGGCGACAGAGTGAGCGTGA<br>CCTGTAAAGCTTCTCAGTCTGTGGACAGCAATGTTGCCTGGTAT<br>CAGCAGAAGCCCAGACAGAGCCCTAAAGCCCTGATCTTTTCTG<br>CCAGCCTGAGATTTTCTGGCGTTCCTGCCAGATTTACCGGCTCT<br>GGCTCTGGCACCGATTTTACACTGACCATCAGCAATCTGCAGTC<br>TGAGGATCTGGCCGAGTACTTTTGCCAGCAGTACAACAACTAC<br>CCCCTGACCTTTGGAGCTGGCACAAAACTGGAGCTGAAG |
| 1478 | Anti-BCMA-2 scFv of CTX-154 and CTX-155 | GACATCGTGATGACCCAAAGCCAGAGGTTCATGACCACATCTG<br>TGGGCGATAGAGTGAGCGTGACCTGTAAAGCCTCTCAGTCTGT<br>GGACAGCAATGTTGCCTGGTATCAGCAGAAGCCTAGACAGAGC<br>CCTAAAGCCCTGATCTTTAGCGCCAGCCTGAGATTTAGCGGAG<br>TTCCTGCCAGATTTACCGGAAGCGGATCTGGAACCGATTTTAC<br>ACTGACCATCAGCAACCTGCAGAGCGAGGATCTGGCCGAGTAC<br>TTTTGCCAGCAGTACAACAATTACCCTCTGACCTTTGGAGCCGG<br>CACAAAGCTGGAGCTGAAAGGAGGAGGAGGATCTGGTGGTGG<br>TGGTTCAGGAGGTGGAGGTTCGGGACAAGTTCAATTACAGCAA<br>TCTGGAGGAGGACTGGTTCAGCCTGGAGGAAGCCTGAAGCTGT<br>CTTGTGCCGCTTCTGGAATCGATTTTAGCAGATACTGGATGAGC |

TABLE 38-continued scFv Nucleotide Sequences

| SEQ ID NO: | Description | Sequence |
|---|---|---|
| | | TGGGTGAGAAGAGCCCCTGGCAAAGGACTGGAGTGGATTGGC<br>GAGATTAATCCTGATAGCAGCACCATCAACTATGCCCCTAGCC<br>TGAAGGACAAGTTCATCATCAGCCGGGACAATGCCAAGAACAC<br>CCTGTACCTGCAAATGAGCAAGGTGAGGAGCGAGGATACAGCT<br>CTGTACTACTGTGCCAGCCTGTACTACGATTACGGAGATGCTAT<br>GGACTATTGGGGCCAGGGAACAAGCGTTACAGTGAGCAGC |
| 1479 | Anti-BCMA scFv of CTX-160 and CTX-160b | GAGGTCCAGCTGGTGGAGAGCGGCGGAGGACTGGTCCAGCCT<br>GGCGGCTCCCTGAAACTGAGCTGCGCCGCCAGCGGCATCGACT<br>TCAGCAGGTACTGGATGAGCTGGGTGAGACAGGCCCCTGGCAA<br>GGGCCTGGAATGGATCGGCGAGATCAACCCCGACTCCAGCACC<br>ATCAACTACGCCGACAGCGTCAAGGGCAGGTTCACCATTAGCA<br>GGGACAATGCCAAGAACACCCTGTACCTGCAGATGAACCTGAG<br>CAGGGCCGAAGACACCGCCCTGTACTACTGTGCCAGCCTGTAC<br>TACGACTATGGCGACGCTATGGACTACTGGGGCCAGGGCACCC<br>TGGTGACAGTGAGCTCCGGAGGAGGCGGCAGCGGCGGAGGCG<br>GCAGCGGCGGAGGCGGCAGCGACATCCAGATGACCCAGAGCC<br>CTAGCAGCCTGAGCGCCTCCGTGGGAGATAGGGTGACAATCAC<br>CTGTAGGGCCAGCCAGAGCGTGGACTCCAACGTGGCCTGGTAT<br>CAACAGAAGCCCGAGAAGGCCCCCAAGAGCCTGATCTTTTCCG<br>CCTCCCTGAGGTTCAGCGGAGTCCCCAGCAGGTTCTCCGGATC<br>CGGCTCCGGAACCGACTTTACCCTGACCATCTCCAGCCTGCAG<br>CCCGAGGACTTCGCCACCTACTACTGCCAGCAGTACAACAGCT<br>ACCCCCCTGACCTTCGGCGCCGGCACAAAGCTGGAGATCAAG |
| 1480 | Anti-BCMA scFv of CTX-161 | GAGGTGCAGCTGGTGGAGAGCGGAGGAGGACTGGTGCAGCCC<br>GGAGGCTCCCTGAAGCTGAGCTGCGCTGCCTCCGGCATCGACT<br>TCAGCAGGTACTGGATGAGCTGGGTGAGGCAGGCTCCCGGCAA<br>AGGCCTGGAGTGGATCGGCGAGATCAACCCCGACAGCAGCAC<br>CATCAACTACGCCGACAGCGTGAAGGGCAGGTTCACCATCAGC<br>AGGGACAACGCCAAGAATACCCTGTACCTGCAGATGAACCTGA<br>GCAGGGCCGAGGACACAGCCCTGTACTACTGTGCCAGCCTGTA<br>CTACGACTATGGAGACGCTATGGACTACTGGGGCCAGGGAACC<br>CTGGTGACCGTGAGCAGCGGAGGCGGAGGCTCCGGCGGCGGA<br>GGCAGCGGAGGAGGCGGCAGCGATATCCAGATGACCCAGTCC<br>CCCAGCTCCCTGAGCGCTAGCCCTGGCGACAGGGTGAGCGTGA<br>CATGCAAGGCCAGCCAGAGCGTGGACAGCAACGTGGCCTGGT<br>ACCAGCAGAAACCCAGACAGGCCCCCAAGGCCCTGATCTTCAG<br>CGCCAGCCTGAGGTTTAGCGGCGTGCCCGCTAGGTTTACCGGA<br>TCCGGCAGCGGCACCGACTTCACCCTGACCATCTCCAACCTGC<br>AGTCCGAGGACTTCGCCACCTACTACTGCCAGCAGTACAACAA<br>CTACCCCCTGACATTCGGCGCCGGAACCAAGCTGGAGATCAAG |
| 1481 | Anti-BCMA scFv of CTX-162 | GACATCCAGATGACCCAGAGCCCTAGCAGCCTGAGCGCTAGCG<br>TGGGCGACAGGGTGACCATCACCTGCAGGGCCAGCCAGAGCGT<br>GGACTCCAACGTGGCCTGGTACCAGCAGAAGCCCGAGAAGGC<br>CCCCAAGAGCCTGATCTTCAGCGCCAGCCTGAGGTTCTCCGGA<br>GTGCCTAGCAGATTTAGCGGCAGCGGCAGCGGCACAGACTTCA<br>CCCTGACCATCAGCAGCCTCCAGCCCGAGGATTTCGCCACCTA<br>CTACTGCCAGCAGTACAACTCCTACCCCCTGACCTTCGGCGCCG<br>GCACAAAGCTGGAGATCAAGGGAGGAGGAGGAAGCGGAGGA<br>GGAGGAAGCGGAGGCGGAGGAAGCGAGGTGCAGCTGGTGGAG<br>TCCGGAGGAGGCCTGGTGCAACCTGGAGGCAGCCTGAAGCTGA<br>GCTGTGCCGCCAGCGGAATCGACTTCAGCAGGTACTGGATGTC<br>CTGGGTGAGACAGGCCCCTGGCAAGGGCCTGGAGTGGATCGG<br>AGAGATCAACCCCGACAGCTCCACCATCAACTACGCCGACAGC<br>GTGAAGGGCAGGTTCACCATCAGCAGAGACAACGCCAAGAAC<br>ACCCTGTACCTGCAGATGAACCTGTCCAGAGCCGAGGACACCG<br>CCCTGTACTACTGCGCCAGCCTGTATTACGACTACGGCGACGCT<br>ATGGACTACTGGGGCCAGGGCACCCTGGTGACAGTGAGCAGC |
| 1482 | Anti-BCMA scFv of CTX-163 | GACATCCAAATGACCCAGTCCCCTAGCAGCCTGTCCGCCAGCC<br>CTGGAGACAGGGTGTCCGTGACCTGCAAGGCCAGCCAGTCCGT<br>GGACAGCAACGTCGCCTGGTATCAGCAGAAGCCCAGGCAAGCT<br>CCCAAGGCTCTGATCTTCTCCGCCAGCCTGAGATTTTCCGGCGT<br>GCCCGCCAGATTCACCGGAAGCGGCAGCGGCACCGACTTCACC<br>CTGACCATCAGCAACCTGCAGAGCGAGGATTTCGCCACATACT<br>ACTGCCAGCAGTACAACAACTACCCCCTGACCTTCGGAGCCGG<br>CACCAAGCTGGAGATCAAAGGCGGCGAGGCAGCGGCGGCGG<br>CGGCAGCGGCGGAGGCGGATCCGAAGTGCAGCTGGTGGAAAG<br>CGGAGGCGGACTCGTGCAGCCTGGCGGAAGCCTGAAGCTGAG<br>CTGTGCCGCCAGCGGCATCGACTTCAGCAGGTACTGGATGAGC<br>TGGGTGAGGCAGGCTCCCGGCAAAGGCCTGGAGTGGATCGGC<br>GAGATCAACCCTGACAGCAGCACCATCAACTACGCCGACAGCG<br>TGAAAGGCAGGTTCACCATCAGCAGGGACAACGCCAAGAACA |

TABLE 38-continued scFv Nucleotide Sequences

| SEQ ID NO: | Description | Sequence |
|---|---|---|
|  |  | CCCTGTACCTGCAGATGAACCTGTCCAGAGCCGAGGACACCGC CCTGTACTACTGCGCCAGCCTGTACTACGACTACGGCGACGCT ATGGACTACTGGGGCCAAGGCACCCTCGTGACCGTCAGCTCC |
| 1483 | Anti-BCMA scFv of CTX-164 | GAGGTGCAGCTGCAGCAGTCCGGCCCTGAGCTCGTGAAGCCTG GAGCCAGCGTGAAAATGAGCTGTAAGGCCTCCGGCAACACCCT CACCAACTACGTGATCCATTGGATGAAGCAGATGCCCGGCCAG GGCCTGGACTGGATTGGCTACATTCTGCCCTACAACGACCTGA CCAAGTACAACGAGAAGTTCACCGGCAAGGCCACCCTGACCAG CGATAAGAGCTCCAGCAGCGCCTACATGGAGCTGAACTCCCTG ACCAGCGAGGACAGCGCCGTGTACTACTGCACCAGGTGGGACT GGGATGGCTTCTTCGACCCCTGGGGACAGGGCACCACCCTGAC AGTGTCCAGCGGAGGAGGCGGCAGCGGCGGCGGCGGCTCCGG CGGCGGCGGCAGCGATATCGTGATGACACAGTCCCCTCTGAGC CTGCCTGTGAGCCTGGGCGACCAGGCCAGCATCAGCTGCAGGT CCAGCCAGTCCCTGGTGCACTCCAACGGCAACACCCACCTGCA CTGGTACCTGCAAAGGCCCGGCCAGTCCCCTAAGCTGCTGATC TACAGCGTGAGCAACAGGTTTAGCGAGGTGCCCGATAGATTTT CCGCCAGCGGCAGCGGCACCGACTTCACACTGAAGATCTCCAG GGTGGAGGCCGAGGATCTGGGCGTGTACTTCTGCAGCCAGACC AGCCACATCCCCTACACCTTCGGCGGCGGAACCAAGCTGGAGA TCAAG |
| 1484 | Anti-BCMA scFv of CTX-165 | GACATCGTGATGACCCAGAGCCCCCTGAGCCTGCCTGTGTCCC TGGGAGACCAGGCTTCCATCAGCTGCAGGTCCACCCAGAGCCT GGTGCACTCCAACGGCAACACCCACCTGCACTGGTACCTGCAG AGGCCTGGCCAGTCCCCCAAGCTGCTGATCTACAGCGTGAGCA ATAGGTTCAGCGAGGTGCCCGACAGATTCAGCGCCAGCGGAAG CGGCACCGACTTCACCCTGAAGATCAGCAGGGTCGAGGCCGAA GATCTGGGCGTGTACTTCTGCTCCCAGACATCCCACATCCCTTA CACCTTCGGCGGCGGCACCAAGCTGGAGATTAAGGGCGGCGG AGGATCCGGCGGAGGAGGATCCGGAGGAGGAGGAAGCGAGGT GCAGCTGCAGCAGAGCGGACCCGAGCTGGTGAAACCCGGAGC CAGCGTCAAAATGAGCTGCAAGGCCAGCGGCAACACCCTGACC AACTACGTCATCCACTGGATGAAGCAGATGCCCGGACAGGGCC TGGACTGGATCGGCTACATCCTGCCCTACAACGACCTGACCAA GTACAACGAGAAATTCACCGGCAAGGCCACCCTGACCAGCGAC AAGAGCAGCAGCAGCGCCTACATGGAGCTGAACAGCCTGACC AGCGAGGACTCCGCCGTGTACTATTGCACCAGGTGGGACTGGG ACGGCTTCTTTGACCCCTGGGGCCAGGGCACAACACTCACCGT GAGCTCC |
| 1485 | Anti-BCMA scFv of CTX-166 and CTX-166b | CAGGTGCAGCTGGTGCAGAGCGGAGCCGAGCTCAAGAAGCCC GGAGCCTCCGTGAAGGTGAGCTGCAAGGCCAGCGGCAACACC CTGACCAACTACGTGATCCACTGGGTGAGACAAGCCCCCGGCC AAAGGCTGGAGTGGATGGGCTACATCCTGCCCTACAACGACCT GACCAAGTACAGCCAGAAGTTCCAGGGCAGGGTGACCATCACC AGGGATAAGAGCGCCTCCACCGCCTATATGGAGCTGAGCAGCC TGAGGAGCGAGGACACCGCTGTGTACTACTGTACAAGGTGGGA CTGGGACGGCTTCTTTGACCCCTGGGGCCAGGGCACAACAGTG ACCGTCAGCAGCGGCGGCGGAGGCAGCGGCGGCGGCGGCAGC GGCGGAGGCGGAAGCGAAATCGTGATGACCCAGAGCCCCGCC ACACTGAGCGTGAGCCCTGGCGAGAGGGCCAGCATCTCCTGCA GGGCTAGCCAAAGCCTGGTGCACAGCAACGGCAACACCCACCT GCACTGGTACCAGCAGAGACCCGGACAGGCTCCCAGGCTGCTG ATCTACAGCGTGAGCAACAGGTTCTCCGAGGTGCCTGCCAGGT TTAGCGGCAGCGGAAGCGGCACCGACTTTACCCTGACCATCAG CAGCGTGGAGTCCGAGGACTTCGCCGTGTATTACTGCAGCCAG ACCAGCCACATCCCTTACACCTTCGGCGGCGCACCAAGCTGG AGATCAAA |
| 1486 | Anti-BCMA scFv of CTX-167 | CAGGTGCAGCTGGTGCAGAGCGGCGCCGAGCTGAAGAAACCT GGCGCCAGCGTCAAGGTGAGCTGCAAGGCTTCCGGAAACACCC TCACCAACTACGTGATCCACTGGGTGAGGCAGGCCCCCGGACA GAGACTGGAGTGGATGGGCTACATTCTGCCCTACAACGACCTG ACCAAGTACAGCCAGAAGTTCCAGGGCAGGGTCACCATCACCA GGGACAAGAGCGCCAGCACCGCCTACATGGAGCTGAGCAGCC TGAGGTCCGAGGACACAGCCGTGTACTACTGCACCAGGTGGGA CTGGGACGGATTCTTCGACCCCTTGGGGCCAAGGCACCACAGTG ACAGTGAGCTCCGGCGGAGGCGGCAGCGGCGGCGGCGGAAGC GGCGGCGGCGGAAGCGACATCGTGATGACCCAGAGCCCTCTGA GCCTGCCCGTGACACTGGGACAGCCTGCCACACTGTCCTGCAG GAGCACCCAGAGCCTGGTGCATAGCAACGGCAACACCCACCTG CACTGGTTCCAGCAGAGACCTGGCCAGAGCCCCCTGAGACTGA TCTACAGCGTGAGCAACAGGGACAGCGGCGTGCCCGATAGATT |

TABLE 38-continued scFv Nucleotide Sequences

| SEQ ID NO: | Description | Sequence |
|---|---|---|
| | | TAGCGGCAGCGGCAGCGGCACCGACTTTACCCTGAAAATCTCC<br>AGGGTGGAGGCCGAGGATGTGGGCGTGTATTACTGCTCCCAGA<br>CAAGCCACATTCCCTATACATTCGGCGGCGGCACCAAGCTGGA<br>GATCAAG |
| 1487 | Anti-BCMA scFv of CTX-168 | GAAATCGTGATGACCCAGAGCCCTGCCACACTGAGCGTGAGCC<br>CTGGCGAGAGAGCCAGCATCAGCTGCAGGGCCTCCCAGAGCCT<br>GGTGCACTCCAACGGCAATACCCACCTGCACTGGTATCAGCAG<br>AGACCCGGCCAGGCCCCTAGGCTGCTGATCTACTCCGTGAGCA<br>ACAGGTTCTCCGAGGTGCCCGCCAGATTCAGCGGATCCGGCAG<br>CGGCACCGACTTCACCCTCACCATCTCCAGCGTGGAGAGCGAG<br>GACTTCGCCGTCTACTACTGCAGCCAGACAAGCCACATCCCCT<br>ACACCTTCGGCGGCGGCACCAAGCTGGAGATCAAGGGCGGCG<br>GCGGCAGCGGCGGCGGAGGCAGCGGAGGCGGCGGATCCCAGG<br>TGCAACTGGTGCAGAGCGGAGCCGAGCTGAAGAAGCCCGGAG<br>CCAGCGTGAAGGTCAGCTGCAAGGCCAGCGGCAACACCCTGAC<br>AAAACTACGTGATCCACTGGGTGAGGCAGGCCCCTGGCCAAAGG<br>CTCGAGTGGATGGGCTACATCCTCCCCTACAACGACCTGACCA<br>AGTACTCCCAGAAGTTCCAGGGCAGGGTGACCATCACCAGGGA<br>TAAGAGCGCCAGCACCGCCTACATGGAACTCAGCAGCCTGAGG<br>AGCGAGGACACCGCCGTGTACTACTGCACCAGGTGGGACTGGG<br>ATGGCTTCTTCGACCCTTGGGGCCAGGGCACCACCGTGACAGT<br>GAGCTCC |
| 1488 | Anti-BCMA scFv of CTX-169 | GACATCGTGATGACACAATCCCCCCTCAGCCTGCCTGTGACAC<br>TGGGCCAGCCTGCCACCCTGAGCTGCAGGAGCACCCAGTCCCT<br>GGTGCACTCCAACGGCAACACCCACCTGCACTGGTTCCAGCAG<br>AGGCCTGGACAGAGCCCCCTGAGGCTGATCTACAGCGTGAGCA<br>ACAGGGACTCCGGCGTGCCCGATAGATTCAGCGGCAGCGGCTC<br>CGGCACCGATTTCACCCTGAAGATCTCCAGAGTGGAAGCCGAG<br>GACGTGGGCGTCTACTACTGCAGCCAGACCAGCCATATCCCCT<br>ACACCTTCGGCGGCGGCACCAAGCTGGAGATCAAGGGAGGCG<br>GCGGAAGCGGCGGAGGCGGATCCGGAGGCGGAGGCTCCCAAG<br>TGCAGCTGGTGCAGAGCGGCGCTGAGCTGAAGAAGCCCGGAG<br>CCAGCGTGAAGGTGAGCTGCAAGGCCAGCGGAAACACCCTGA<br>CCAACTACGTGATCCACTGGGTGAGACAGGCCCCCGGACAGAG<br>ACTCGAGTGGATGGGCTACATCCTGCCCTACAACGACCTGACC<br>AAGTACAGCCAGAAGTTCCAGGGCAGGGTGACAATCACCAGG<br>GACAAGAGCGCCAGCACCGCCTACATGGAGCTGAGCAGCCTG<br>AGATCCGAGGACACCGCCGTGTACTACTGCACCAGGTGGGACT<br>GGGACGGCTTCTTTGACCCCTGGGGCCAGGGAACCACAGTGAC<br>CGTGTCCTCC |
| 1489 | Anti-BCMA scFv of CTX-170 | GAGGTGCAGCTGCAGCAGAGCGGCCCTGAGCTGGTGAAGCCC<br>GGCGCCAGCGTGAAGATCAGCTGCAAGACCTCCGGCTATACCT<br>TTACCGAGTACACCATCAACTGGGTGAAGCAGAGCCACGGCAA<br>GAGCCTGGAGTGGATCGGCGATATCTACCCCGACAACTACAAC<br>ATCAGGTACAACCAGAAGTTCAAGGGCAAGGCCACCCTGACCG<br>TGGACAAGTCCAGCAGCACCGCCTACATGGAGCTGAGGAGCCT<br>GTCCAGCGAGGACTCCGCCATCTACTACTGCGCCAACCACGAC<br>TTTTTCGTCTTCTGGGGACAGGGCACCCTGGTGACAGTGTCCGC<br>TGGCGGCGGCGGCAGCGGCGGCGGCGGCTCCGGAGGCGGCGG<br>CAGCGGACATCCAGATGACACAGGCCACAAGCTCCCTGTCCGCC<br>AGCCTGGGCGATAGGGTGACCATCAATTGCAGGACCTCCCAGG<br>ACATCAGCAACCACCTGAACTGGTACCAGCAGAAACCCGACGG<br>CACCGTGAAGCTGCTCATCTACTACACCAGCAGGCTGCAGTCC<br>GGCGTCCCTAGCAGATTCAGCGGATCCGGCAGCGGCACCGACT<br>ATAGCCTGACCATCAGCAACCTCGAGCAGGAGGACATCGGCAC<br>CTACTTCTGCCATCAGGGCAACACCCTGCCCCCTACCTTTGGCG<br>GCGGCACAAAGCTGGAGATTAAG |
| 1490 | Anti-BCMA scFv of CTX-171 | GATATCCAGATGACCCAGGCCACCAGCAGCCTGAGCGCTTCCC<br>TCGGCGACAGGGTGACCATCAACTGCAGGACCAGCCAGGACAT<br>CTCCAACCACCTGAACTGGTACCAGCAGAAGCCCGACGGCACC<br>GTGAAACTGCTGATCTACTACACCAGCAGACTGCAGAGCGGCG<br>TGCCCTCCAGATTTTCCGGCAGCGGCTCCGGCACCGACTACAG<br>CCTGACCATTAGCAACCTGGAGCAGGAGGACATCGGAACCTAC<br>TTCTGCCACCAGGGCAACACACTGCCTCCCACCCTTCGGCGGCG<br>GCACAAAGCTCGAGATCAAGGGCGGCGGCGGAAGCGGCGGCG<br>GCGGCAGCGGCGGCGGAGGCTCCGAGGTGCAACTGCAACAGA<br>GCGGACCTGAGCTGGTGAAGCCTGGCGCCAGCGTGAAGATCTC<br>CTGTAAGACCAGCGGCTACACCTTCACCGAGTACACCATCAAC<br>TGGGTGAAGCAGAGCCACGGCAAGAGCCTCGAATGGATCGGC<br>GACATCTATCCCGACAACTACAATATCAGATACAACCAGAAGT<br>TCAAGGGAAAGGCCACCCTGACCGTGGATAAGTCCTCCTCCAC |

TABLE 38-continued scFv Nucleotide Sequences

| SEQ ID NO: | Description | Sequence |
|---|---|---|
| | | CGCTTACATGGAGCTGAGGAGCCTGAGCAGCGAGGACTCCGCC<br>ATCTACTACTGCGCCAACCACGACTTCTTCGTGTTCTGGGGCCA<br>AGGCACCCTCGTGACCGTGAGCGCC |
| 1491 | Anti-BCMA scFv of CTX-172 | CAGGTGCAGCTGGTGCAGTCCGGCGCTGAGCTGAAGAAGCCCG<br>GCGCCAGCGTGAAGATCAGCTGCAAGGCCAGCGGCTACACCTT<br>CACCGAATACACCATCAACTGGGTGAGACAGGCCCCTGGACAG<br>AGGCTCGAGTGGATGGGCGACATCTACCCCGACAACTACAGCA<br>TCAGGTACAACCAGAAGTTCCAGGGCAGGGTGACAATCACCAG<br>GGACACCAGCGCCAGCACCGCCTATATGGAGCTGAGCAGCCTG<br>AGATCCGAGGACACCGCCGTCTATTACTGCGCCAACCACGACT<br>TCTTCGTGTTCTGGGGCCAGGGAACACTGGTGACCGTGTCCAG<br>CGGCGGCGGCGGCAGCGGCGGCGGAGGAAGCGGCGGCGGCGG<br>CAGCGATATCCAGATGACCCAGAGCCCCTCCTCCCTGAGCGCT<br>AGCGTGGGCGACAGGGTGACCATTACCTGTCAGGCCTCCCAGG<br>ACATCAGCAACTACCTGAACTGGTACCAGCAGAAGCCTGGCAA<br>GGCCCCCAAGCTGCTGATCTATTACACCAGCAGGCTGGAGACC<br>GGCGTGCCCTCCAGATTCAGCGGCTCCGGCTCCGGAACCGACT<br>TCACCTTCACCATCAGCTCCCTGCAGCCTGAGGACATCGCCACC<br>TACTACTGCCAGCAGGGCAACACCCTGCCTCCCACATTCGGCG<br>GCGGCACAAAGGTGGAGATCAAA |
| 1492 | Anti-BCMA scFv of CTX-173 | CAGGTGCAGCTGGTCCAGTCCGGCGCCGAACTGAAGAAGCCTG<br>GCGCCAGCGTGAAGATCAGCTGCAAGGCCTCCGGCTACACCTT<br>CACCGAGTACACCATCAACTGGGTGAGGCAAGCCCCCGGCCAG<br>AGACTGGAGTGGATGGGCGACATCTACCCCGACAACTACAGCA<br>TCAGGTACAACCAGAAGTTCCAGGGCAGGGTGACAATCACCAG<br>GGATACCAGCGCCAGCACAGCCTATATGGAGCTGTCCTCCCTG<br>AGATCCGAGGACACCGCCGTGTATTACTGCGCCAACCACGACT<br>TCTTCGTGTTCTGGGGCCAAGGCACCCTGGTGACCGTGAGCAG<br>CGGCGGCGGCGGCTCCGGCGGCGAGGCTCCGGAGGCGGAGG<br>CAGCGACATCCAGATGACCCAGAGCCCTTCCAGCCTGAGCGCT<br>AGCCTGGGCGACAGGGTGACCATCACCTGCAGGACCAGCCAG<br>GACATCAGCAATCACCTGAACTGGTACCAGCAAAAGCCCGGCA<br>AGGCCCCTAAGCTGCTGATCTACTACACCAGCAGGCTGGAAAG<br>CGGCGTGCCTAGCAGGTTCAGCGGCAGCGGCTCCGGAACCGAC<br>TACAGCCTGACCATTAGCAGCCTGCAACCTGAGGACATCGGCA<br>CCTATTACTGCCAGCAGGGCAACACCCTGCCTCCTACCTTTGGC<br>GGCGGCACCAAACTCGAGATCAAG |
| 1493 | Anti-BCMA scFv of CTX-174 | CAGGTGCAGCTGGTGCAGAGCGGCCCTGAGCTGAAGAAGCCC<br>GGAGCCAGCGTGAAGATCTCCTGCAAGACCTCCGGCTACACCT<br>TCACCGAGTACACCATCAACTGGGTGAAGCAGGCCCCCGGACA<br>GGGACTGGAATGGATCGGCGACATCTACCCCGACAACTACAAC<br>ATCAGGTACAACCAGAAGTTCCAAGGCAAGGCCACCATCACAA<br>GGGACACCAGCAGCAGCACCGCCTACATGGAGCTGAGCAGCCTT<br>GAGGAGCGAGGATACCGCCGTGTACTACTGCGCCAACCACGAC<br>TTCTTCGTGTTCTGGGGCCAGGGCACCCTGGTGACAGTGAGCA<br>GCGGAGGAGGCGGAAGCGGAGGAGGAGGATCCGGAGGAGGA<br>GGCAGCGACATCCAGATGACCCAGTCCCCCTCCTCCCTGAGCG<br>CCTCCGTGGGAGACAGGGTGACCATCACCTGCCAGGCCAGCCA<br>GGACATCAGCAACTACCTGAACTGGTACCAGCAGAAGCCCGGC<br>AAGGCCCCCAAGCTGCTGATTTACTACACCAGCAGGCTGGAAA<br>CCGGCGTGCCCAGCAGATTTAGCGGCAGCGGCAGCGGCACCGA<br>CTTTACCTTTACCATCTCCAGCCTGCAGCCCGAGGATATCGCCA<br>CATACTACTGCCAGCAGGGCAACACCCTCCCCCCTACCTTTGGC<br>GGCGGCACCAAGGTGGAGATTAAG |
| 1494 | Anti-BCMA scFv of CTX-175 | CAGGTGCAGCTGGTGCAGTCCGGCCCCGAACTGAAAAAGCCCG<br>GCGCCAGCGTGAAGATCAGCTGCAAGACCTCCGGCTACACCTT<br>CACCGAGTACACCATCAACTGGGTGAAGCAGGCCCCCGGCCAG<br>GGACTGGAATGGATTGGCGACATCTACCCCGACAACTACAACA<br>TTAGGTATAACCAGAAGTTCCAGGGCAAGGCCACCATCACAAG<br>AGACACCAGCAGCAGCACCGCCTACATGGAGCTGAGCAGCCTG<br>AGGAGCGAGGACACCGCCGTGTACTACTGCGCCAACCACGACT<br>TCTTCGTGTTCTGGGGCCAGGGAACCCTGGTGACAGTGTCCAG<br>CGGCGGCGGCGGCTCCGGCGGCGGCGGCTCCGGCGGCGGCGG<br>CAGCGACATTCAGATGACACAGAGCCCCTCCAGCCTGAGCGCC<br>AGCCTGGGCGATAGGGTGACCATCACCTGCAGAACCAGCCAGG<br>ACATCAGCAACCACCTGAATTGGTACCAGCAGAAGCCCGGAAA<br>GGCCCCCAAGCTGCTGATCTACTACACCAGCAGGCTGGAGAGC<br>GGCGTGCCTAGCAGGTTTAGCGGCAGCGGCAGCGGCACAGATT<br>ACAGCCTGACCATCAGCAGCCTGCAGCCCGAAGACATCGGCAC<br>CTACTACTGCCAGCAGGGCAACACCCTGCCCCCTACCTTTGGC<br>GGAGGCACCAAGCTGGAGATCAAG |

TABLE 38-continued scFv Nucleotide Sequences

| SEQ ID NO: | Description | Sequence |
|---|---|---|
| 1495 | Anti-BCMA scFv of CTX-176 | GACATCCAGATGACACAGAGCCCTAGCAGCCTGAGCGCTTCCG TGGGCGACAGGGTGACCATCACCTGCCAGGCCAGCCAGGACAT CAGCAACTACCTCAACTGGTACCAGCAGAAGCCCGGCAAGGCC CCTAAGCTGCTGATCTACTACACCTCCAGGCTGGAGACCGGAG TGCCCTCCAGATTTTCCGGCAGCGGCAGCGGCACCGATTTCAC CTTCACCATCAGCAGCCTGCAGCCCGAGGACATCGCCACCTAC TATTGCCAGCAGGGCAACACCCTGCCCCCCACATTTGGAGGCG GCACCAAGGTGGAGATCAAGGGCGGAGGAGGAAGCGGAGGAG GAGGAAGCGGAGGAGGCGGAAGCCAGGTGCAGCTGGTGCAGA GCGGCGCTGAGCTCAAGAAGCCTGGCGCCAGCGTGAAGATCA GCTGCAAAGCCTCCGGATACACCTTCACCGAGTACACCATCAA TTGGGTGAGACAGGCCCCCGGCCAAAGACTGGAGTGGATGGG CGACATCTATCCCGACAACTACAGCATCAGGTACAACCAGAAG TTCCAGGGCAGGGTGACAATCACCAGAGACACCAGCGCCAGC ACCGCCTACATGGAGCTGAGCCTGAGGAGCGAGGACACC GCCGTGTACTACTGCGCCAATCACGACTTCTTCGTGTTCTGGGG CCAGGGAACCCTGGTGACCGTCAGCTCC |
| 1496 | Anti-BCMA scFv of CTX-177 | GATATCCAGATGACACAGAGCCCTAGCTCCCTGAGCGCCAGCC TGGGCGATAGGGTGACCATCACCTGCAGGACCTCCCAGGACAT CAGCAACCACCTGAACTGGTACCAGCAGAAGCCCGGCAAAGC CCCCAAGCTGCTGATCTACTACACCAGCAGGCTGGAAAGCGGC GTGCCCAGCAGGTTTAGCGGAAGCGGCAGCGGCACCGACTACA GCCTGACCATCAGCTCCCTGCAGCCCGAGGACATCGGCACCTA CTACTGCCAGCAGGGCAACACCCTGCCTCCCACCTTCGGAGGC GGAACCAAGCTGGAGATTAAGGGAGGCGGCGGAAGCGGCGGC GGCGGCTCCGGCGGAGGAGGCAGCCAGGTGCAGCTGGTGCAG TCCGGAGCCGAGCTGAAAAAGCCTGGCGCCAGCGTGAAGATC AGCTGCAAGGCCAGCGGCTACACCTTCACCGAGTACACCATCA ACTGGGTGAGGCAGGCCCCTGGCCAGAGACTCGAGTGGATGG GCGACATCTACCCCGACAACTACTCCATCAGGTACAACCAGAA GTTTCAGGGCAGGGTGACCATTACCAGGGACACCAGCGCCAGC ACAGCCTACATGGAGCTGAGCAGCCTGAGGAGCGAGGATACA GCCGTCTACTACTGCGCCAACCACGACTTTTTCGTGTTCTGGGG ACAGGGCACCCTGGTGACCGTGTCCTCC |
| 1497 | Anti-BCMA scFv of CTX-178 | GACATCCAAATGACCCAGAGCCCTAGCTCCCTGAGCGCTTCCG TGGGCGACAGAGTGACCATTACCTGCCAGGCCAGCCAGGACAT CAGCAACTACCTGAACTGGTATCAGCAGAAGCCTGGCAAGGCC CCCAAGCTGCTGATCTACTACACCAGCAGGCTGGAGACCGGAG TGCCCAGCAGGTTTAGCGGCTCCGGATCCGGCACCGACTTCAC CTTCACCATCTCCAGCCTGCAGCCCGAGGACATCGCCACCTACT ACTGCCAGCAGGGCAATACCCTCCCCCCTACCTTCGGAGGCGG CACCAAGGTGGAGATCAAGGGCGGCGGCGGCTCCGGCGGCGG CGGCAGCGGCGGAGGCGGCAGCCAGGTGCAACTGGTGCAGAG CGGCCCTGAGCTGAAGAAACCCGGCGCCAGCGTGAAAATCAG CTGCAAGACCAGCGGCTACACATTCACCGAGTACACCATCAAC TGGGTGAAGCAGGCTCCCGGACAGGGACTGGAGTGGATCGGC GACATCTACCCTGACAACTACAACATCAGATACAACCAAAAGT TCCAGGGCAAGGCCACCATCACCAGGGACACCAGCTCCTCCAC CGCCTACATGGAGCTGAGCAGCCTGAGGAGCGAGGACACCGCT GTGTACTACTGCGCCAACCACGACTTCTTCGTGTTCTGGGGCCA GGGAACCCTGGTGACCGTGAGCAGC |
| 1498 | Anti-BCMA scFv of CTX-179 | GATATCCAGATGACACAAAGCCCCAGCAGCCTGTCCGCTAGCC TGGGCGATAGGGTGACCATCACATGCAGGACCAGCCAGGACAT CTCCAACCACCTGAACTGGTACCAGCAGAAGCCTGGAAAGGCC CCCAAACTGCTGATCTACTACACCAGCAGGCTGGAGAGCGGCG TGCCTAGCAGGTTTTCCGGCAGCGGCAGCGGCACCGACTATAG CCTGACCATCAGCTCCCTGCAGCCCGAGGACATCGGCACCTAC TACTGCCAGCAGGGAAACACACTGCCCCCCACCTTTGGCGGCG GCACAAAGCTGGAGATCAAGGGCGGCGGCGGATCCGGCGGCG GAGGCAGCGGAGGAGGAGGAAGCCAGGTGCAGCTGGTGCAGT CCGGCCCTGAGCTGAAGAAGCCCGGAGCCAGCGTGAAAATTA GCTGCAAGACCTCCGGCTACACATTCACCGAGTACACCATCAA CTGGGTGAAGCAGGCTCCCGGCCAGGGACTGGAGTGGATCGGC GACATCTACCCCGACAACTACAACATCAGGTACAACCAGAAAT TCCAGGGCAAGGCCACCATCACCAGGGACACCAGCTCCTCCAC CGCCTATATGGAGCTGTCCAGCCTGAGAAGCGAGGATACCGCC GTGTACTACTGCGCCAACCACGATTTCTTCGTGTTCTGGGGCCA GGGCACACTGGTCACCGTGAGCAGC |

TABLE 39 scFv Amino Acid Sequences

| SEQ ID NO: | Description | Sequence |
|---|---|---|
| 1334 | Anti-CD19 scFv of CTX-131 to CTX-141 | IQMTQTTSSLSASLGDRVTISCRASQDISKYLNWYQQKPDGTVKL LIYHTSRLHSGVPSRFSGSGSGTDYSLTISNLEQEDIATYFCQQGNT LPYTFGGGTKLEITGSTSGSGKPGSGEGSTKGEVKLQESGPGLVAP SQSLSVTCTVSGVSLPDYGVSWIRQPPRKGLEWLGVIWGSETTYY NSALKSRLTIIKDNSKSQVFLKMNSLQTDDTAIYYCAKHYYYGGS YAMDYWGQGTSVTVS |
| 1499 | Anti-CD70A scFv of CTX-142 | DIVMTQSPDSLAVSLGERATINCRASKSVSTSGYSFMHWYQQKPG QPPKLLIYLASNLESGVPDRFSGSGSGTDFTLTISSLQAEDVAVYY CQHSREVPWTFGQGTKVEIKGGGGSGGGGSGGGGSGQVQLVQSG AEVKKPGASVKVSCKASGYTFTNYGMNWVRQAPGQGLKWMGW INTYTGEPTYADAFKGRVTMTRDTSISTAYMELSRLRSDDTAVYY CARDYGDYGMDYWGQGTTVTVSS |
| 1500 | Anti-CD70B scFv of CTX-145 and CTX-145b | QVQLVQSGAEVKKPGASVKVSCKASGYTFTNYGMNWVRQAPGQ GLKWMGWINTYTGEPTYADAFKGRVTMTRDTSISTAYMELSRLR SDDTAVYYCARDYGDYGMDYWGQGTTVTVSSGGGGSGGGGSG GGGSGDIVMTQSPDSLAVSLGERATINCRASKSVSTSGYSFMHWY QQKPGQPPKLLIYLASNLESGVPDRFSGSGSGTDFTLTISSLQAEDV AVYYCQHSREVPWTFGQGTKVEIK |
| 1501 | Anti-BCMA-1 scFv of CTX 152 and CTX-153 | QVQLQQSGGGLVQPGGSLKLSCAASGIDFSRYWMSWVRRAPGK GLEWIGEINPDSSTINYAPSLKDKFIISRDNAKNTLYLQMSKVRSED TALYYCASLYYDYGDAMDYWGQGTSVTVSSGGGGSGGGGSGG GGSGDIVMTQSQRFMTTSVGDRVSVTCKASQSVDSNVAWYQQK PRQSPKALIFSASLRFSGVPARFTGSGSGTDFTLTISNLQSEDLAEY FCQQYNNYPLTFGAGTKLELK |
| 1502 | Anti-BCMA-2 scFv of CTX-154 and CTX-155 | DIVMTQSQRFMTTSVGDRVSVTCKASQSVDSNVAWYQQKPRQSP KALIFSASLRFSGVPARFTGSGSGTDFTLTISNLQSEDLAEYFCQQY NNYPLTFGAGTKLELKGGGGSGGGGSGGGGSGQVQLQQSGGGL VQPGGSLKLSCAASGIDFSRYWMSWVRRAPGKGLEWIGEINPDSS TINYAPSLKDKFIISRDNAKNTLYLQMSKVRSEDTALYYCASLYY DYGDAMDYWGQGTSVTVSS |
| 1503 | Anti-BCMA scFv of CTX-160 and CTX-160b (BCMA-3) | EVQLVESGGGLVQPGGSLKLSCAASGIDFSRYWMSWVRQAPGKG LEWIGEINPDSSTINYADSVKGRFTISRDNAKNTLYLQMNLSRAED TALYYCASLYYDYGDAMDYWGQGTLVTVSSGGGGSGGGGSGG GGSDIQMTQSPSSLSASVGDRVTITCRASQSVDSNVAWYQQKPEK APKSLIFSASLRFSGVPSRFSGSGSGTDFTLTISSLQPEDFATYYCQQ YNSYPLTFGAGTKLEIK |
| 1504 | Anti-BCMA scFv of CTX-161 (BCMA-4) | EVQLVESGGGLVQPGGSLKLSCAASGIDFSRYWMSWVRQAPGKG LEWIGEINPDSSTINYADSVKGRFTISRDNAKNTLYLQMNLSRAED TALYYCASLYYDYGDAMDYWGQGTLVTVSSGGGGSGGGGSGG GGSDIQMTQSPSSLSASPGDRVSVTCKASQSVDSNVAWYQQKPR QAPKALIFSASLRFSGVPARFTGSGSGTDFTLTISNLQSEDFATYYC QQYNNYPLTFGAGTKLEIK |
| 1505 | Anti-BCMA scFv of CTX-162 (BCMA-5) | DIQMTQSPSSLSASVGDRVTITCRASQSVDSNVAWYQQKPEKAPK SLIFSASLRFSGVPSRFSGSGSGTDFTLTISSLQPEDFATYYCQQYNS YPLTFGAGTKLEIKGGGGSGGGGSGGGGSEVQLVESGGGLVQPG GSLKLSCAASGIDFSRYWMSWVRQAPGKGLEWIGEINPDSSTINY ADSVKGRFTISRDNAKNTLYLQMNLSRAEDTALYYCASLYYDYG DAMDYWGQGTLVTVSS |
| 1506 | Anti-BCMA scFv of CTX-163 (BCMA-6) | DIQMTQSPSSLSASPGDRVSVTCKASQSVDSNVAWYQQKPRQAP KALIFSASLRFSGVPARFTGSGSGTDFTLTISNLQSEDFATYYCQQY NNYPLTFGAGTKLEIKGGGGSGGGGSGGGGSEVQLVESGGGLVQ PGGSLKLSCAASGIDFSRYWMSWVRQAPGKGLEWIGEINPDSSTI NYADSVKGRFTISRDNAKNTLYLQMNLSRAEDTALYYCASLYYD YGDAMDYWGQGTLVTVSS |
| 1507 | Anti-BCMA scFv of CTX-164 (BCMA-7) | EVQLQQSGPELVKPGASVKMSCKASGNTLTNYVIHWMKQMPGQ GLDWIGYILPYNDLTKYNEKFTGKATLTSDKSSSSAYMELNSLTSE DSAVYYCTRWDWDGFFDPWGQGTTLTVSSGGGGSGGGGSGGGG SDIVMTQSPLSLPVSLGDQASISCRSTQSLVHSNGNTHLHWYLQRP GQSPKLLIYSVSNRFSEVPDRFSASGSGTDFTLKISRVEAEDLGVYF CSQTSHIPYTFGGGTKLEIK |

TABLE 39-continued scFv Amino Acid Sequences

| SEQ ID NO: | Description | Sequence |
|---|---|---|
| 1508 | Anti-BCMA scFv of CTX-165 (BCMA-8) | DIVMTQSPLSLPVSLGDQASISCRSTQSLVHSNGNTHLHWYLQRP GQSPKLLIYSVSNRFSEVPDRFSASGSGTDFTLKISRVEAEDLGVYF CSQTSHIPYTFGGGTKLEIKGGGGSGGGGSGGGGSEVQLQQSGPE LVKPGASVKMSCKASGNTLTNYVIHWMKQMPGQGLDWIGYILP YNDLTKYNEKFTGKATLTSDKSSSSAYMELNSLTSEDSAVYYCTR WDWDGFFDPWGQGTTLTVSS |
| 1509 | Anti-BCMA scFv of CTX-166 (BCMA-11) and CTX-166b | QVQLVQSGAELKKPGASVKVSCKASGNTLTNYVIHWVRQAPGQR LEWMGYILPYNDLTKYSQKFQGRVTITRDKSASTAYMELSSLRSE DTAVYYCTRWDWDGFFDPWGQGTTVTVSSGGGGSGGGGSGGG GSEIVMTQSPATLSVSPGERASISCRASQSLVHSNGNTHLHWYQQ RPGQAPRLLIYSVSNRFSEVPARFSGSGSGTDFTLTISSVESEDFAV YYCSQTSHIPYTFGGGTKLEIK |
| 1510 | Anti-BCMA scFv of CTX-167 (BCMA-12) | QVQLVQSGAELKKPGASVKVSCKASGNTLTNYVIHWVRQAPGQR LEWMGYILPYNDLTKYSQKFQGRVTITRDKSASTAYMELSSLRSE DTAVYYCTRWDWDGFFDPWGQGTTVTVSSGGGGSGGGGSGGG GSDIVMTQSPLSLPVTLGQPATLSCRSTQSLVHSNGNTHLHWFQQ RPGQSPLRLIYSVSNRDSGVPDRFSGSGSGTDFTLKISRVEAEDVG VYYCSQTSHIPYTFGGGTKLEIK |
| 1511 | Anti-BCMA scFv of CTX-168 (BCMA-13) | EIVMTQSPATLSVSPGERASISCRASQSLVHSNGNTHLHWYQQRP GQAPRLLIYSVSNRFSEVPARFSGSGSGTDFTLTISSVESEDFAVYY CSQTSHIPYTFGGGTKLEIKGGGGSGGGGSGGGGSQVQLVQSGAE LKKPGASVKVSCKASGNTLTNYVIHWVRQAPGQRLEWMGYILPY NDLTKYSQKFQGRVTITRDKSASTAYMELSSLRSEDTAVYYCTR WDWDGFFDPWGQGTTVTVSS |
| 1512 | Anti-BCMA scFv of CTX-169 (BCMA-14) | DIVMTQSPLSLPVTLGQPATLSCRSTQSLVHSNGNTHLHWFQQRP GQSPLRLIYSVSNRDSGVPDRFSGSGSGTDFTLKISRVEAEDVGVY YCSQTSHIPYTFGGGTKLEIKGGGGSGGGGSGGGGSQVQLVQSGA ELKKPGASVKVSCKASGNTLTNYVIHWVRQAPGQRLEWMGYILP YNDLTKYSQKFQGRVTITRDKSASTAYMELSSLRSEDTAVYYCTR WDWDGFFDPWGQGTTVTVSS |
| 1513 | Anti-BCMA scFv of CTX-170 (BCMA-9) | EVQLQQSGPELVKPGASVKISCKTSGYTFTEYTINWVKQSHGKSL EWIGDIYPDNYNIRYNQKFKGKATLTVDKSSSTAYMELRSLSSED SAIYYCANHDFFVFWGQGTLVTVSAGGGGSGGGGSGGGGSDIQM TQATSSLSASLGDRVTINCRTSQDISNHLNWYQQKPDGTVKLLIY YTSRLQSGVPSRFSGSGSGTDYSLTISNLEQEDIGTYFCHQGNTLPP TFGGGTKLEIK |
| 1514 | Anti-BCMA scFv of CTX-171 (BCMA-10) | DIQMTQATSSLSASLGDRVTINCRTSQDISNHLNWYQQKPDGTVK LLIYYTSRLQSGVPSRFSGSGSGTDYSLTISNLEQEDIGTYFCHQGN TLPPTFGGGTKLEIKGGGGSGGGGSGGGGSEVQLQQSGPELVKPG ASVKISCKTSGYTFTEYTINWVKQSHGKSLEWIGDIYPDNYNIRYN QKFKGKATLTVDKSSSTAYMELRSLSSEDSAIYYCANHDFFVFWG QGTLVTVSA |
| 1515 | Anti-BCMA scFv of CTX-172 (BCMA-15) | QVQLVQSGAELKKPGASVKISCKASGYTFTEYTINWVRQAPGQRL EWMGDIYPDNYSIRYNQKFQGRVTITRDTSASTAYMELSSLRSED TAVYYCANHDFFVFWGQGTLVTVSSGGGGSGGGGSGGGGSDIQ MTQSPSSLSASVGDRVTITCQASQDISNYLNWYQQKPGKAPKLLI YYTSRLETGVPSRFSGSGSGTDFTFTISSLQPEDIATYYCQQGNTLP PTFGGGTKVEIK |
| 1516 | Anti-BCMA scFv of CTX-173 (BCMA-16) | QVQLVQSGAELKKPGASVKISCKASGYTFTEYTINWVRQAPGQRL EWMGDIYPDNYSIRYNQKFQGRVTITRDTSASTAYMELSSLRSED TAVYYCANHDFFVFWGQGTLVTVSSGGGGSGGGGSGGGGSDIQ MTQSPSSLSASLGDRVTITCRTSQDISNHLNWYQQKPGKAPKLLIY YTSRLESGVPSRFSGSGSGTDYSLTISSLQPEDIGTYYCQQGNTLPP TFGGGTKLEIK |
| 1517 | Anti-BCMA scFv of CTX-174 (BCMA-17) | QVQLVQSGPELKKPGASVKISCKTSGYTFTEYTINWVKQAPGQGL EWIGDIYPDNYNIRYNQKFQGKATITRDTSSSTAYMELSSLRSEDT AVYYCANHDFFVFWGQGTLVTVSSGGGGSGGGGSGGGGSDIQM TQSPSSLSASVGDRVTITCQASQDISNYLNWYQQKPGKAPKLLIYY TSRLETGVPSRFSGSGSGTDFTFTISSLQPEDIATYYCQQGNTLPPTF GGGTKVEIK |
| 1518 | Anti-BCMA scFv of CTX-175 (BCMA-18) | QVQLVQSGPELKKPGASVKISCKTSGYTFTEYTINWVKQAPGQGL EWIGDIYPDNYNIRYNQKFQGKATITRDTSSSTAYMELSSLRSEDT AVYYCANHDFFVFWGQGTLVTVSSGGGGSGGGGSGGGGSDIQM TQSPSSLSASLGDRVTITCRTSQDISNHLNWYQQKPGKAPKLLIYY |

TABLE 39-continued scFv Amino Acid Sequences

| SEQ ID NO: | Description | Sequence |
|---|---|---|
| | | TSRLESGVPSRFSGSGSGTDYSLTISSLQPEDIGTYYCQQGNTLPPT FGGGTKLEIK |
| 1519 | Anti-BCMA scFv of CTX-176 (BCMA-19) | DIQMTQSPSSLSASVGDRVTITCQASQDISNYLNWYQQKPGKAPK LLIYYTSRLETGVPSRFSGSGSGTDFTFTISSLQPEDIATYYCQQGN TLPPTFGGGTKVEIKGGGGSGGGGSGGGGSQVQLVQSGAELKKP GASVKISCKASGYTFTEYTINWVRQAPGQRLEWMGDIYPDNYSIR YNQKFQGRVTITRDTSASTAYMELSSLRSEDTAVYYCANHDFFVF WGQGTLVTVSS |
| 1520 | Anti-BCMA scFv of CTX-177 (BCMA-20) | DIQMTQSPSSLSASLGDRVTITCRTSQDISNHLNWYQQKPGKAPKL LIYYTSRLESGVPSRFSGSGSGTDYSLTISSLQPEDIGTYYCQQGNT LPPTFGGGTKLEIKGGGGSGGGGSGGGGSQVQLVQSGAELKKPG ASVKISCKASGYTFTEYTINWVRQAPGQRLEWMGDIYPDNYSIRY NQKFQGRVTITRDTSASTAYMELSSLRSEDTAVYYCANHDFFVFW GQGTLVTVSS |
| 1521 | Anti-BCMA scFv of CTX-178 (BCMA-21) | DIQMTQSPSSLSASVGDRVTITCQASQDISNYLNWYQQKPGKAPK LLIYYTSRLETGVPSRFSGSGSGTDFTFTISSLQPEDIATYYCQQGN TLPPTFGGGTKVEIKGGGGSGGGGSGGGGSQVQLVQSGPELKKPG ASVKISCKTSGYTFTEYTINWVKQAPGQGLEWIGDIYPDNYNIRY NQKFQGKATITRDTSSSTAYMELSSLRSEDTAVYYCANHDFFVFW GQGTLVTVSS |
| 1522 | Anti-BCMA scFv of CTX-179 (BCMA-22) | DIQMTQSPSSLSASLGDRVTITCRTSQDISNHLNWYQQKPGKAPKL LIYYTSRLESGVPSRFSGSGSGTDYSLTISSLQPEDIGTYYCQQGNT LPPTFGGGTKLEIKGGGGSGGGGSGGGGSQVQLVQSGPELKKPGA SVKISCKTSGYTFTEYTINWVKQAPGQGLEWIGDIYPDNYNIRYN QKFQGKATITRDTSSSTAYMELSSLRSEDTAVYYCANHDFFVFWG QGTLVTVSS |
| 1523 | BCMA_VH1 | QVQLQQSGGGLVQPGGSLKLSCAASGIDFSRYWMSWVRRAPGK GLEWIGEINPDSSTINYAPSLKDKFIISRDNAKNTLYLQMSKVRSED TALYYCASLYYDYGDAMDYWGQGTSVTVSS |
| 1524 | BCMA_VH1.1 (of CTX-160) | EVQLVESGGGLVQPGGSLKLSCAASGIDFSRYWMSWVRQAPGKG LEWIGEINPDSSTINYADSVKGRFTISRDNAKNTLYLQMNLSRAED TALYYCASLYYDYGDAMDYWGQGTLVTVSS |
| 1525 | BCMA_VL1 | DIVMTQSQRFMTTSVGDRVSVTCKASQSVDSNVAWYQQKPRQSP KALIFSASLRFSGVPARFTGSGSGTDFTLTISNLQSEDLAEYFCQQY NNYPLTFGAGTKLELK |
| 1526 | BCMA_VL1.1 (of CTX-160) | DIQMTQSPSSLSASVGDRVTITCRASQSVDSNVAWYQQKPEKAPK SLIFSASLRFSGVPSRFSGSGSGTDFTLTISSLQPEDFATYYCQQYNS YPLTFGAGTKLEIK |
| 1527 | BCMA_VL1.2 | DIQMTQSPSSLSASPGDRVSVTCKASQSVDSNVAWYQQKPRQAP KALIFSASLRFSGVPARFTGSGSGTDFTLTISNLQSEDFATYYCQQY NNYPLTFGAGTKLEIK |
| 1528 | BCMA_VH2 | EVQLQQSGPELVKPGASVKMSCKASGNTLTNYVIHWMKQMPGQ GLDWIGYILPYNDLTKYNEKFTGKATLTSDKSSSSAYMELNSLTSE DSAVYYCTRWDWDGFFDPWGQGTTLTVSS |
| 1529 | BCMA_VL2 | DIVMTQSPLSLPVSLGDQASISCRSTQSLVHSNGNTHLHWYLQRP GQSPKLLIYSVSNRFSEVPDRFSASGSGTDFTLKISRVEAEDLGVYF CSQTSHIPYTFGGGTKLEIK |
| 1530 | BCMA_VH3 | EVQLQQSGPELVKPGASVKISCKTSGYTFTEYTINWVKQSHGKSL EWIGDIYPDNYNIRYNQKFKGKATLTVDKSSSTAYMELRSLSSED SAIYYCANHDFFVFWGQGTLVTVSA |
| 1531 | BCMA_VL3 | DIQMTQATSSLSASLGDRVTINCRTSQDISNHLNWYQQKPDGTVK LLIYYTSRLQSGVPSRFSGSGSGTDYSLTISNLEQEDIGTYFCHQGN TLPPTFGGGTKLEIK |
| 1589 | BCMA VH (of CTX-166) | QVQLVQSGAELKKPGASVKVSCKASGNTLTNYVIHWVRQAPGQR LEWMGYILPYNDLTKYSQKFQGRVTITRDKSASTAYMELSSLRSE DTAVYYCTRWDWDGFFDPWGQGTTVTVSS |
| 1590 | BCMA VL (of CTX-166) | EIVMTQSPATLSVSPGERASISCRASQSLVHSNGNTHLHWYQQRP GQAPRLLIYSVSNRFSEVPARFSGSGSGTDFTLTISSVESEDFAVYY CSQTSHIPYTFGGGTKLEIK |

TABLE 39-continued scFv Amino Acid Sequences

| SEQ ID NO: | Description | Sequence |
|---|---|---|
| 1591 | BCMA linker | GGGGSGGGGSGGGGS |
| 1592 | CD70 VH | QVQLVQSGAEVKKPGASVKVSCKASGYTFTNYGMNWVRQAPGQGLKWMGWINTYTGEPTYADAFKGRVTMTRDTSISTAYMELSRLRSDDTAVYYCARDYGDYGMDYWGQGTTVTVSS |
| 1593 | CD70 VL | DIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIK |
| 1594 | CD70 linker | GGGGSGGGGSGGGGSG |
| 1595 | CD19 VH | EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS |
| 1596 | CD19 VL | DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEIT |
| 1597 | CD19 linker | GSTSGSGKPGSGEGSTKG |

Note Regarding Illustrative Examples

While the present disclosure provides descriptions of various specific aspects for the purpose of illustrating various aspects of the present invention and/or its potential applications, it is understood that variations and modifications will occur to those skilled in the art. Accordingly, the invention or inventions described herein should be understood to be at least as broad as they are claimed, and not as more narrowly defined by particular illustrative aspects provided herein.

Any patent, publication, or other disclosure material identified herein is incorporated by reference into this specification in its entirety unless otherwise indicated, but only to the extent that the incorporated material does not conflict with existing descriptions, definitions, statements, or other disclosure material expressly set forth in this specification. As such, and to the extent necessary, the express disclosure as set forth in this specification supersedes any conflicting material incorporated by reference. Any material, or portion thereof, that is said to be incorporated by reference into this specification, but which conflicts with existing definitions, statements, or other disclosure material set forth herein, is only incorporated to the extent that no conflict arises between that incorporated material and the existing disclosure material. Applicants reserve the right to amend this specification to expressly recite any subject matter, or portion thereof, incorporated by reference herein.

SEQUENCE LISTING (1602 sequences)

SEQ ID NO: 1 - RNA, 100 nt, Artificial Sequence
  Synthetic polynucleotide
  misc_feature (1)..(20): n is a, c, g, or u
nnnnnnnnnnnnnnnnnnnnguuuuagagcuagaaauagcaaguuaaaauaaggcuaguccguuaucaacuugaaaaaguggcaccgagucggugcuuuu

SEQ ID NO: 2 - RNA, 96 nt, Artificial Sequence
  Synthetic polynucleotide
  misc_feature (1)..(20): n is a, c, g, or u
nnnnnnnnnnnnnnnnnnnnguuuuagagcuagaaauagcaaguuaaaauaaggcuaguccguuaucaacuugaaaaaguggcaccgagucggugc

SEQ ID NO: 3 - RNA, 114 nt, Artificial Sequence
  Synthetic polynucleotide
  misc_feature (1)..(17): n is a, c, g, or u
  misc_feature (18)..(30): May be absent
  misc_feature (108)..(114): May be absent
nnnnnnnnnnnnnnnnnnnnnnnnnnnnnnguuuuagagcuagaaauagcaaguuaaaauaaggcuaguccguuaucaacuugaaaaaguggcaccgagucggugcuuuuuuuu

SEQ ID NO: 4 - protein, 9 aa, Artificial Sequence
  Synthetic polypeptide
LAGLIDADG

SEQ ID NO: 5 - protein, 6 aa, Artificial Sequence
  Synthetic polypeptide
GIYYIG

SEQ ID NO: 6 - protein, 5 aa, Artificial Sequence
  Synthetic polypeptide
  MISC_FEATURE (3)..(3): May be Asp or Glu
  misc_feature (4)..(4): Xaa can be any naturally occurring amino acid
PDXXK

SEQ ID NO: 7 - DNA, 20 bp, Artificial Sequence
  Synthetic polynucleotide
gtaaaaccaagaggccacag

SEQ ID NO: 8 - DNA, 20 bp, Artificial Sequence
  Synthetic polynucleotide
gactgtgcctctgtttgact

SEQ ID NO: 9 - DNA, 20 bp, Artificial Sequence
  Synthetic polynucleotide
gttatgggcttgcatgtccc

SEQ ID NO: 10 - DNA, 20 bp, Artificial Sequence
  Synthetic polynucleotide
tctctcagctggtacacggc

SEQ ID NO: 11 - DNA, 20 bp, Artificial Sequence
  Synthetic polynucleotide
caccaaagctgcccttacct

SEQ ID NO: 12 - DNA, 20 bp, Artificial Sequence
  Synthetic polynucleotide
gagaatcaaaatcggtgaat

SEQ ID NO: 13 - DNA, 20 bp, Artificial Sequence
  Synthetic polynucleotide
atcctcctcctgaaagtggc

SEQ ID NO: 14 - DNA, 20 bp, Artificial Sequence
  Synthetic polynucleotide
agcaaggaaacagcctgcga

SEQ ID NO: 15 - DNA, 20 bp, Artificial Sequence
  Synthetic polynucleotide
tgtgctagacatgaggtcta

SEQ ID NO: 16 - DNA, 20 bp, Artificial Sequence
  Synthetic polynucleotide
ccgaatcctcctcctgaaag

SEQ ID NO: 17 - DNA, 20 bp, Artificial Sequence
  Synthetic polynucleotide
ccactttcaggaggaggatt

SEQ ID NO: 18 - DNA, 20 bp, Artificial Sequence
  Synthetic polynucleotide
catcacaggaactttctaaa

SEQ ID NO: 19 - DNA, 20 bp, Artificial Sequence
  Synthetic polynucleotide
cgtcatgagcagattaaacc

SEQ ID NO: 20 - DNA, 20 bp, Artificial Sequence
  Synthetic polynucleotide
taggcagacagacttgtcac

SEQ ID NO: 21 - DNA, 20 bp, Artificial Sequence
  Synthetic polynucleotide
acccggccactttcaggagg

SEQ ID NO: 22 - DNA, 20 bp, Artificial Sequence
  Synthetic polynucleotide
gcaccaaagctgcccttacc

SEQ ID NO: 23 - DNA, 20 bp, Artificial Sequence
  Synthetic polynucleotide
acctggccattcctgaagca

SEQ ID NO: 24 - DNA, 20 bp, Artificial Sequence
  Synthetic polynucleotide
taccaaacccagtcaaacag

SEQ ID NO: 25 - DNA, 20 bp, Artificial Sequence
  Synthetic polynucleotide
gacaccttcttccccagccc

SEQ ID NO: 26 - DNA, 20 bp, Artificial Sequence
  Synthetic polynucleotide
tctgtttgactgggtttggt

SEQ ID NO: 27 - DNA, 20 bp, Artificial Sequence
  Synthetic polynucleotide
tcctcctcctgaaagtggcc

SEQ ID NO: 28 - DNA, 20 bp, Artificial Sequence
  Synthetic polynucleotide
agactgtgcctctgtttgac

SEQ ID NO: 29 - DNA, 20 bp, Artificial Sequence
  Synthetic polynucleotide
atgcaagcccataaccgctg

SEQ ID NO: 30 - DNA, 20 bp, Artificial Sequence
  Synthetic polynucleotide
gctttgaaacaggtaagaca

SEQ ID NO: 31 - DNA, 20 bp, Artificial Sequence
  Synthetic polynucleotide
caagaggccacagcggttat

SEQ ID NO: 32 - DNA, 20 bp, Artificial Sequence
  Synthetic polynucleotide
ccataaccgctgtggcctct

SEQ ID NO: 33 - DNA, 20 bp, Artificial Sequence
  Synthetic polynucleotide
acaaaactgtgctagacatg

SEQ ID NO: 34 - DNA, 20 bp, Artificial Sequence
  Synthetic polynucleotide
ttcggaacccaatcactgac

SEQ ID NO: 35 - DNA, 20 bp, Artificial Sequence
  Synthetic polynucleotide
gattaaacccggccactttc

SEQ ID NO: 36 - DNA, 20 bp, Artificial Sequence
  Synthetic polynucleotide
tctgtgggacaagaggatca

SEQ ID NO: 37 - DNA, 20 bp, Artificial Sequence
  Synthetic polynucleotide
gctggtacacggcagggtca

SEQ ID NO: 38 - DNA, 20 bp, Artificial Sequence
  Synthetic polynucleotide
ctctcagctggtacacggca

SEQ ID NO: 39 - DNA, 20 bp, Artificial Sequence
  Synthetic polynucleotide
ctgacaggttttgaaagttt

SEQ ID NO: 40 - DNA, 20 bp, Artificial Sequence
  Synthetic polynucleotide
agagtctctcagctggtaca

SEQ ID NO: 41 - DNA, 20 bp, Artificial Sequence
  Synthetic polynucleotide
ctcgaccagcttgacatcac

SEQ ID NO: 42 - DNA, 20 bp, Artificial Sequence
  Synthetic polynucleotide
taaacccggccactttcagg

SEQ ID NO: 43 - DNA, 20 bp, Artificial Sequence
  Synthetic polynucleotide
gtcagggttctggatatctg

SEQ ID NO: 44 - DNA, 20 bp, Artificial Sequence
  Synthetic polynucleotide
ttcgtatctgtaaaaccaag

SEQ ID NO: 45 - DNA, 20 bp, Artificial Sequence
  Synthetic polynucleotide
cttcaagagcaacagtgctg

SEQ ID NO: 46 - DNA, 20 bp, Artificial Sequence
  Synthetic polynucleotide
ctggatatctgtgggacaag

SEQ ID NO: 47 - DNA, 20 bp, Artificial Sequence
  Synthetic polynucleotide
aagttcctgtgatgtcaagc

SEQ ID NO: 48 - DNA, 20 bp, Artificial Sequence
  Synthetic polynucleotide
ggcagctttggtgccttcgc

SEQ ID NO: 49 - DNA, 20 bp, Artificial Sequence
  Synthetic polynucleotide
cttcttccccagcccaggta

SEQ ID NO: 50 - DNA, 20 bp, Artificial Sequence
  Synthetic polynucleotide
ttcaaaacctgtcagtgatt

SEQ ID NO: 51 - DNA, 20 bp, Artificial Sequence
  Synthetic polynucleotide
tcagggttctggatatctgt

SEQ ID NO: 52 - DNA, 20 bp, Artificial Sequence
  Synthetic polynucleotide
gtcgagaaaagctttgaaac

SEQ ID NO: 53 - DNA, 20 bp, Artificial Sequence
  Synthetic polynucleotide
ttaatctgctcatgacgctg

SEQ ID NO: 54 - DNA, 20 bp, Artificial Sequence
  Synthetic polynucleotide
ctgtttccttgcttcaggaa

SEQ ID NO: 55 - DNA, 20 bp, Artificial Sequence
  Synthetic polynucleotide
tggatttagagtctctcagc

SEQ ID NO: 56 - DNA, 20 bp, Artificial Sequence
  Synthetic polynucleotide
cttacctgggctggggaaga

SEQ ID NO: 57 - DNA, 20 bp, Artificial Sequence
  Synthetic polynucleotide
agcccaggtaagggcagctt

SEQ ID NO: 58 - DNA, 20 bp, Artificial Sequence
  Synthetic polynucleotide
gggacaagaggatcagggtt

SEQ ID NO: 59 - DNA, 20 bp, Artificial Sequence
  Synthetic polynucleotide
ttcttccccagcccaggtaa

SEQ ID NO: 60 - DNA, 20 bp, Artificial Sequence
  Synthetic polynucleotide
tgcctctgtttgactgggtt

SEQ ID NO: 61 - DNA, 20 bp, Artificial Sequence
  Synthetic polynucleotide
agctggtacacggcagggtc

SEQ ID NO: 62 - DNA, 20 bp, Artificial Sequence
  Synthetic polynucleotide
tgctcatgacgctgcggctg

SEQ ID NO: 63 - DNA, 20 bp, Artificial Sequence
  Synthetic polynucleotide
tttcaaaacctgtcagtgat

SEQ ID NO: 64 - DNA, 20 bp, Artificial Sequence
  Synthetic polynucleotide
acacggcagggtcagggttc

SEQ ID NO: 65 - DNA, 20 bp, Artificial Sequence
  Synthetic polynucleotide
agctttgaaacaggtaagac

SEQ ID NO: 66 - DNA, 20 bp, Artificial Sequence
  Synthetic polynucleotide
ctggggaagaaggtgtcttc

SEQ ID NO: 67 - DNA, 20 bp, Artificial Sequence
  Synthetic polynucleotide
tccttgcttcaggaatggcc

SEQ ID NO: 68 - DNA, 20 bp, Artificial Sequence
  Synthetic polynucleotide
aagctgcccttacctgggct

SEQ ID NO: 69 - DNA, 20 bp, Artificial Sequence
  Synthetic polynucleotide
aacaaatgtgtcacaaagta

SEQ ID NO: 70 - DNA, 20 bp, Artificial Sequence
  Synthetic polynucleotide
aaagtcagatttgttgctcc

SEQ ID NO: 71 - DNA, 20 bp, Artificial Sequence
  Synthetic polynucleotide
agctgcccttacctgggctg

SEQ ID NO: 72 - DNA, 20 bp, Artificial Sequence
  Synthetic polynucleotide
tggaataatgctgttgttga

SEQ ID NO: 73 - DNA, 20 bp, Artificial Sequence
  Synthetic polynucleotide
atttgtttgagaatcaaaat

SEQ ID NO: 74 - DNA, 20 bp, Artificial Sequence
  Synthetic polynucleotide
aaagctgcccttacctgggc

SEQ ID NO: 75 - DNA, 20 bp, Artificial Sequence
  Synthetic polynucleotide
ccaagaggccacagcggtta

SEQ ID NO: 76 - DNA, 20 bp, Artificial Sequence
  Synthetic polynucleotide
agagcaacagtgctgtggcc

SEQ ID NO: 77 - DNA, 20 bp, Artificial Sequence
  Synthetic polynucleotide
atctgtgggacaagaggatc

SEQ ID NO: 78 - DNA, 20 bp, Artificial Sequence
  Synthetic polynucleotide
ggtaagacaggggtctagcc

SEQ ID NO: 79 - DNA, 20 bp, Artificial Sequence
  Synthetic polynucleotide
gtaagacaggggtctagcct

SEQ ID NO: 80 - DNA, 20 bp, Artificial Sequence
  Synthetic polynucleotide
gcaggctgtttccttgcttc

SEQ ID NO: 81 - DNA, 20 bp, Artificial Sequence
  Synthetic polynucleotide
ctttgaaacaggtaagacag

SEQ ID NO: 82 - DNA, 20 bp, Artificial Sequence
  Synthetic polynucleotide
agaggcacagtctcttcagc

SEQ ID NO: 83 - RNA, 20 nt, Artificial Sequence
  Synthetic polynucleotide
guaaaaccaagaggccacag

SEQ ID NO: 84 - RNA, 20 nt, Artificial Sequence
  Synthetic polynucleotide
gacugugccucuguuugacu

SEQ ID NO: 85 - RNA, 20 nt, Artificial Sequence
  Synthetic polynucleotide
guuaugggcuugcauguccc

SEQ ID NO: 86 - RNA, 20 nt, Artificial Sequence
  Synthetic polynucleotide
ucucucagcugguacacggc

SEQ ID NO: 87 - RNA, 20 nt, Artificial Sequence
  Synthetic polynucleotide
caccaaagcugcccuuaccu

SEQ ID NO: 88 - RNA, 20 nt, Artificial Sequence
  Synthetic polynucleotide
gagaaucaaaaucggugaau

SEQ ID NO: 89 - RNA, 20 nt, Artificial Sequence
  Synthetic polynucleotide
auccuccuccugaaaguggc

SEQ ID NO: 90 - RNA, 20 nt, Artificial Sequence
  Synthetic polynucleotide
agcaaggaaacagccugcga

SEQ ID NO: 91 - RNA, 20 nt, Artificial Sequence
  Synthetic polynucleotide
ugugcuagacaugaggucua

SEQ ID NO: 92 - RNA, 20 nt, Artificial Sequence
  Synthetic polynucleotide
ccgaauccuccuccugaaag

SEQ ID NO: 93 - RNA, 20 nt, Artificial Sequence
  Synthetic polynucleotide
ccacuuucaggaggaggauu

SEQ ID NO: 94 - RNA, 20 nt, Artificial Sequence
  Synthetic polynucleotide
caucacaggaacuuucuaaa

SEQ ID NO: 95 - RNA, 20 nt, Artificial Sequence
  Synthetic polynucleotide
cgucaugagcagauuaaacc

SEQ ID NO: 96 - RNA, 20 nt, Artificial Sequence
  Synthetic polynucleotide
uaggcagacagacuugucac

SEQ ID NO: 97 - RNA, 20 nt, Artificial Sequence
  Synthetic polynucleotide
acccggccacuuucaggagg

SEQ ID NO: 98 - RNA, 20 nt, Artificial Sequence
  Synthetic polynucleotide
gcaccaaagcugcccuuacc

SEQ ID NO: 99 - RNA, 20 nt, Artificial Sequence
  Synthetic polynucleotide
accuggccauuccugaagca

SEQ ID NO: 100 - RNA, 20 nt, Artificial Sequence
  Synthetic polynucleotide
uaccaaacccagucaaacag

SEQ ID NO: 101 - RNA, 20 nt, Artificial Sequence
  Synthetic polynucleotide
gacaccuucuuccccagccc

SEQ ID NO: 102 - RNA, 20 nt, Artificial Sequence
  Synthetic polynucleotide
ucuguuugacuggguuuggu

SEQ ID NO: 103 - RNA, 20 nt, Artificial Sequence
  Synthetic polynucleotide
uccuccuccugaaaguggcc

SEQ ID NO: 104 - RNA, 20 nt, Artificial Sequence
  Synthetic polynucleotide
agacugugccucuguuugac

SEQ ID NO: 105 - RNA, 20 nt, Artificial Sequence
  Synthetic polynucleotide
augcaagcccauaaccgcug

SEQ ID NO: 106 - RNA, 20 nt, Artificial Sequence
  Synthetic polynucleotide
gcuuugaaacagguaagaca

SEQ ID NO: 107 - RNA, 20 nt, Artificial Sequence
  Synthetic polynucleotide
caagaggccacagcgguuau

SEQ ID NO: 108 - RNA, 20 nt, Artificial Sequence
  Synthetic polynucleotide
ccauaaccgcuguggccucu

SEQ ID NO: 109 - RNA, 20 nt, Artificial Sequence
  Synthetic polynucleotide
acaaaacugugcuagacaug

SEQ ID NO: 110 - RNA, 20 nt, Artificial Sequence
  Synthetic polynucleotide
uucggaacccaaucacugac

SEQ ID NO: 111 - RNA, 20 nt, Artificial Sequence
  Synthetic polynucleotide
gauuaaacccggccacuuuc

SEQ ID NO: 112 - RNA, 20 nt, Artificial Sequence
  Synthetic polynucleotide
ucugugggacaagaggauca

SEQ ID NO: 113 - RNA, 20 nt, Artificial Sequence
  Synthetic polynucleotide
gcugguacacggcaggguca

SEQ ID NO: 114 - RNA, 20 nt, Artificial Sequence
  Synthetic polynucleotide
cucucagcugguacacggca

SEQ ID NO: 115 - RNA, 20 nt, Artificial Sequence
  Synthetic polynucleotide
cugacagguuuugaaaguuu

SEQ ID NO: 116 - RNA, 20 nt, Artificial Sequence
  Synthetic polynucleotide
agagucucucagcugguaca

SEQ ID NO: 117 - RNA, 20 nt, Artificial Sequence
  Synthetic polynucleotide
cucgaccagcuugacaucac

SEQ ID NO: 118 - RNA, 20 nt, Artificial Sequence
  Synthetic polynucleotide
uaaacccggccacuuucagg

SEQ ID NO: 119 - RNA, 20 nt, Artificial Sequence
  Synthetic polynucleotide
gucaggguucuggauaucug

SEQ ID NO: 120 - RNA, 20 nt, Artificial Sequence
  Synthetic polynucleotide
uucguaucuguaaaaccaag

SEQ ID NO: 121 - RNA, 20 nt, Artificial Sequence
  Synthetic polynucleotide
cuucaagagcaacagugcug

SEQ ID NO: 122 - RNA, 20 nt, Artificial Sequence
  Synthetic polynucleotide
cuggauaucugugggacaag

SEQ ID NO: 123 - RNA, 20 nt, Artificial Sequence
  Synthetic polynucleotide
aaguuccugugaugucaagc

SEQ ID NO: 124 - RNA, 20 nt, Artificial Sequence
  Synthetic polynucleotide
ggcagcuuuggugccuucgc

SEQ ID NO: 125 - RNA, 20 nt, Artificial Sequence
  Synthetic polynucleotide
cuucuuccccagcccaggua

SEQ ID NO: 126 - RNA, 20 nt, Artificial Sequence
  Synthetic polynucleotide
uucaaaaccugucagugauu

SEQ ID NO: 127 - RNA, 20 nt, Artificial Sequence
  Synthetic polynucleotide
ucaggguucuggauaucugu

SEQ ID NO: 128 - RNA, 20 nt, Artificial Sequence
  Synthetic polynucleotide
gucgagaaaagcuuugaaac

SEQ ID NO: 129 - RNA, 20 nt, Artificial Sequence
  Synthetic polynucleotide
uuaaucugcucaugacgcug

SEQ ID NO: 130 - RNA, 20 nt, Artificial Sequence
  Synthetic polynucleotide
cuguuuccuugcuucaggaa

SEQ ID NO: 131 - RNA, 20 nt, Artificial Sequence
  Synthetic polynucleotide
uggauuuagagucucucagc

SEQ ID NO: 132 - RNA, 20 nt, Artificial Sequence
  Synthetic polynucleotide
cuuaccugggcuggggaaga

SEQ ID NO: 133 - RNA, 20 nt, Artificial Sequence
  Synthetic polynucleotide
agcccagguaagggcagcuu

SEQ ID NO: 134 - RNA, 20 nt, Artificial Sequence
  Synthetic polynucleotide
gggacaagaggaucaggguu

SEQ ID NO: 135 - RNA, 20 nt, Artificial Sequence
  Synthetic polynucleotide
uucuuccccagcccagguaa

SEQ ID NO: 136 - RNA, 20 nt, Artificial Sequence
  Synthetic polynucleotide
ugccucuguuugacuggguu

SEQ ID NO: 137 - RNA, 20 nt, Artificial Sequence
  Synthetic polynucleotide
agcugguacacggcaggguc

SEQ ID NO: 138 - RNA, 20 nt, Artificial Sequence
  Synthetic polynucleotide
ugcucaugacgcugcggcug

SEQ ID NO: 139 - RNA, 20 nt, Artificial Sequence
  Synthetic polynucleotide
uuucaaaaccugucagugau

SEQ ID NO: 140 - RNA, 20 nt, Artificial Sequence
  Synthetic polynucleotide
acacggcagggucaggguuc

SEQ ID NO: 141 - RNA, 20 nt, Artificial Sequence
  Synthetic polynucleotide
agcuuugaaacagguaagac

SEQ ID NO: 142 - RNA, 20 nt, Artificial Sequence
  Synthetic polynucleotide
cuggggaagaaggugucuuc

SEQ ID NO: 143 - RNA, 20 nt, Artificial Sequence
  Synthetic polynucleotide
uccuugcuucaggaauggcc

SEQ ID NO: 144 - RNA, 20 nt, Artificial Sequence
  Synthetic polynucleotide
aagcugcccuuaccugggcu

SEQ ID NO: 145 - RNA, 20 nt, Artificial Sequence
  Synthetic polynucleotide
aacaaaugugucacaaagua

SEQ ID NO: 146 - RNA, 20 nt, Artificial Sequence
  Synthetic polynucleotide
aaagucagauuuguugcucc

SEQ ID NO: 147 - RNA, 20 nt, Artificial Sequence
  Synthetic polynucleotide
agcugcccuuaccugggcug

SEQ ID NO: 148 - RNA, 20 nt, Artificial Sequence
  Synthetic polynucleotide
uggaauaaugcuguuguuga

SEQ ID NO: 149 - RNA, 20 nt, Artificial Sequence
  Synthetic polynucleotide
auuuguuugagaaucaaaau

SEQ ID NO: 150 - RNA, 20 nt, Artificial Sequence
  Synthetic polynucleotide
aaagcugcccuuaccugggc

SEQ ID NO: 151 - RNA, 20 nt, Artificial Sequence
  Synthetic polynucleotide
ccaagaggccacagcgguua

SEQ ID NO: 152 - RNA, 20 nt, Artificial Sequence
  Synthetic polynucleotide
agagcaacagugcuguggcc

SEQ ID NO: 153 - RNA, 20 nt, Artificial Sequence
  Synthetic polynucleotide
aucugugggacaagaggauc

SEQ ID NO: 154 - RNA, 20 nt, Artificial Sequence
  Synthetic polynucleotide
gguaagacaggggucuagcc

SEQ ID NO: 155 - RNA, 20 nt, Artificial Sequence
  Synthetic polynucleotide
guaagacaggggucuagccu

SEQ ID NO: 156 - RNA, 20 nt, Artificial Sequence
  Synthetic polynucleotide
gcaggcuguuuccuugcuuc

SEQ ID NO: 157 - RNA, 20 nt, Artificial Sequence
  Synthetic polynucleotide
cuuugaaacagguaagacag

SEQ ID NO: 158 - RNA, 20 nt, Artificial Sequence
  Synthetic polynucleotide
agaggcacagucucuucagc

SEQ ID NO: 159 - DNA, 20 bp, Artificial Sequence
  Synthetic polynucleotide
gtcagaggagattcctgcca

SEQ ID NO: 160 - DNA, 20 bp, Artificial Sequence
  Synthetic polynucleotide
agaggagattcctgccaagg

SEQ ID NO: 161 - DNA, 20 bp, Artificial Sequence
  Synthetic polynucleotide
gaacttttatctctacctga

SEQ ID NO: 162 - DNA, 20 bp, Artificial Sequence
  Synthetic polynucleotide
aagcctgtgacacgaggagc

SEQ ID NO: 163 - DNA, 20 bp, Artificial Sequence
  Synthetic polynucleotide
catcctactcacctgataag

SEQ ID NO: 164 - DNA, 20 bp, Artificial Sequence
  Synthetic polynucleotide
ctggattacctcttgccctc

SEQ ID NO: 165 - DNA, 20 bp, Artificial Sequence
  Synthetic polynucleotide
catgaaacaaagatgcagtc

SEQ ID NO: 166 - DNA, 20 bp, Artificial Sequence
  Synthetic polynucleotide
atttcagatccaggatactg

SEQ ID NO: 167 - DNA, 20 bp, Artificial Sequence
  Synthetic polynucleotide
tcagaggagattcctgccaa

SEQ ID NO: 168 - DNA, 20 bp, Artificial Sequence
  Synthetic polynucleotide
gcagttctcacacactgtgg

SEQ ID NO: 169 - DNA, 20 bp, Artificial Sequence
  Synthetic polynucleotide
cacaatgataaaaacatagg

SEQ ID NO: 170 - DNA, 20 bp, Artificial Sequence
  Synthetic polynucleotide
gtgtgagaactgcatggaga

SEQ ID NO: 171 - DNA, 20 bp, Artificial Sequence
  Synthetic polynucleotide
gatgtccactatgacaattg

SEQ ID NO: 172 - DNA, 20 bp, Artificial Sequence
  Synthetic polynucleotide
actcacctgataagaggcag

SEQ ID NO: 173 - DNA, 20 bp, Artificial Sequence
  Synthetic polynucleotide
ctcttatcaggtgagtagga

SEQ ID NO: 174 - DNA, 20 bp, Artificial Sequence
  Synthetic polynucleotide
tatctctacctgagggcaag

SEQ ID NO: 175 - DNA, 20 bp, Artificial Sequence
  Synthetic polynucleotide
atcctggatctgaaatacta

SEQ ID NO: 176 - DNA, 20 bp, Artificial Sequence
  Synthetic polynucleotide
agatggagactttatatgct

SEQ ID NO: 177 - DNA, 20 bp, Artificial Sequence
  Synthetic polynucleotide
ctgcctcttatcaggtgagt

SEQ ID NO: 178 - DNA, 20 bp, Artificial Sequence
  Synthetic polynucleotide
tatatgctggggagaaagaa

SEQ ID NO: 179 - DNA, 20 bp, Artificial Sequence
  Synthetic polynucleotide
agtggacatctgcatcactg

SEQ ID NO: 180 - DNA, 20 bp, Artificial Sequence
  Synthetic polynucleotide
caagcctgtgacacgaggag

SEQ ID NO: 181 - DNA, 20 bp, Artificial Sequence
  Synthetic polynucleotide
gtggacatctgcatcactgg

SEQ ID NO: 182 - DNA, 20 bp, Artificial Sequence
  Synthetic polynucleotide
gatggagactttatatgctg

SEQ ID NO: 183 - DNA, 20 bp, Artificial Sequence
  Synthetic polynucleotide
tctcacacactgtggggggt

SEQ ID NO: 184 - DNA, 20 bp, Artificial Sequence
  Synthetic polynucleotide
caggcaaaggggtaaggctg

SEQ ID NO: 185 - DNA, 20 bp, Artificial Sequence
  Synthetic polynucleotide
gttacctcatagtctgggtt

SEQ ID NO: 186 - DNA, 20 bp, Artificial Sequence
  Synthetic polynucleotide
cttctggtttgcttcctctg

SEQ ID NO: 187 - DNA, 20 bp, Artificial Sequence
  Synthetic polynucleotide
atgcagttctcacacactgt

SEQ ID NO: 188 - DNA, 20 bp, Artificial Sequence
  Synthetic polynucleotide
cccacgttacctcatagtct

SEQ ID NO: 189 - DNA, 20 bp, Artificial Sequence
  Synthetic polynucleotide
ttcctccgcaggacaaaaca

SEQ ID NO: 190 - DNA, 20 bp, Artificial Sequence
  Synthetic polynucleotide
ctgggcctctgcctcttatc

SEQ ID NO: 191 - DNA, 20 bp, Artificial Sequence
  Synthetic polynucleotide
ggagatggatgtgatgtcgg

SEQ ID NO: 192 - DNA, 20 bp, Artificial Sequence
  Synthetic polynucleotide
tgttcccaacccagactatg

SEQ ID NO: 193 - DNA, 20 bp, Artificial Sequence
  Synthetic polynucleotide
acacgaggagcgggtgctgg

SEQ ID NO: 194 - DNA, 20 bp, Artificial Sequence
  Synthetic polynucleotide
ttatatgctggggagaaaga

SEQ ID NO: 195 - DNA, 20 bp, Artificial Sequence
  Synthetic polynucleotide
tttcagatccaggatactga

SEQ ID NO: 196 - DNA, 20 bp, Artificial Sequence
  Synthetic polynucleotide
catggagatggatgtgatgt

SEQ ID NO: 197 - DNA, 20 bp, Artificial Sequence
  Synthetic polynucleotide
agatgcagtcgggcactcac

SEQ ID NO: 198 - DNA, 20 bp, Artificial Sequence
  Synthetic polynucleotide
tattatgtctgctaccccag

SEQ ID NO: 199 - DNA, 20 bp, Artificial Sequence
  Synthetic polynucleotide
gtttcccctccttcctccgc

SEQ ID NO: 200 - DNA, 20 bp, Artificial Sequence
  Synthetic polynucleotide
taaaaacataggcagtgatg

SEQ ID NO: 201 - DNA, 20 bp, Artificial Sequence
  Synthetic polynucleotide
ggtggccacaattgtcatag

SEQ ID NO: 202 - DNA, 20 bp, Artificial Sequence
  Synthetic polynucleotide
gcatataaagtctccatctc

SEQ ID NO: 203 - DNA, 20 bp, Artificial Sequence
  Synthetic polynucleotide
tattactgtggttccagaga

SEQ ID NO: 204 - DNA, 20 bp, Artificial Sequence
  Synthetic polynucleotide
caacacaatgataaaaacat

SEQ ID NO: 205 - DNA, 20 bp, Artificial Sequence
  Synthetic polynucleotide
gtaatccaggtctccagaac

SEQ ID NO: 206 - DNA, 20 bp, Artificial Sequence
  Synthetic polynucleotide
cccagactatgaggtaacgt

SEQ ID NO: 207 - DNA, 20 bp, Artificial Sequence
  Synthetic polynucleotide
atagtggacatctgcatcac

SEQ ID NO: 208 - DNA, 20 bp, Artificial Sequence
  Synthetic polynucleotide
atcttctggtttgcttcctc

SEQ ID NO: 209 - DNA, 20 bp, Artificial Sequence
  Synthetic polynucleotide
ttttgtcctgcggaggaagg

SEQ ID NO: 210 - DNA, 20 bp, Artificial Sequence
  Synthetic polynucleotide
ctgagggcaagaggtaatcc

SEQ ID NO: 211 - DNA, 20 bp, Artificial Sequence
  Synthetic polynucleotide
ttgacatgccctcagtatcc

SEQ ID NO: 212 - DNA, 20 bp, Artificial Sequence
  Synthetic polynucleotide
cagaggagattcctgccaag

SEQ ID NO: 213 - DNA, 20 bp, Artificial Sequence
  Synthetic polynucleotide
tgctgctgctggtttactac

SEQ ID NO: 214 - DNA, 20 bp, Artificial Sequence
  Synthetic polynucleotide
gaggtaacgtgggatagaaa

SEQ ID NO: 215 - DNA, 20 bp, Artificial Sequence
  Synthetic polynucleotide
acccagactatgaggtaacg

SEQ ID NO: 216 - DNA, 20 bp, Artificial Sequence
  Synthetic polynucleotide
cactgggggcttgctgctgc

SEQ ID NO: 217 - DNA, 20 bp, Artificial Sequence
  Synthetic polynucleotide
atcaggtgagtaggatggag

SEQ ID NO: 218 - DNA, 20 bp, Artificial Sequence
  Synthetic polynucleotide
ggcactcactggagagttct

SEQ ID NO: 219 - DNA, 20 bp, Artificial Sequence
  Synthetic polynucleotide
tttgtcctgcggaggaagga

SEQ ID NO: 220 - DNA, 20 bp, Artificial Sequence
  Synthetic polynucleotide
tgaggatcacctgtcactga

SEQ ID NO: 221 - DNA, 20 bp, Artificial Sequence
  Synthetic polynucleotide
ttactttactaagatggcgg

SEQ ID NO: 222 - DNA, 20 bp, Artificial Sequence
  Synthetic polynucleotide
taaaaacataggcggtgatg

SEQ ID NO: 223 - DNA, 20 bp, Artificial Sequence
  Synthetic polynucleotide
ctgaaaattccttcagtgac

SEQ ID NO: 224 - DNA, 20 bp, Artificial Sequence
  Synthetic polynucleotide
ttgtcctgcggaggaaggag

SEQ ID NO: 225 - DNA, 20 bp, Artificial Sequence
  Synthetic polynucleotide
tcttctggtttgcttcctct

SEQ ID NO: 226 - DNA, 20 bp, Artificial Sequence
  Synthetic polynucleotide
gggcactcactggagagttc

SEQ ID NO: 227 - DNA, 20 bp, Artificial Sequence
  Synthetic polynucleotide
ttctcacacactgtgggggg

SEQ ID NO: 228 - DNA, 20 bp, Artificial Sequence
  Synthetic polynucleotide
cgggtgctggcggcaggcaa

SEQ ID NO: 229 - DNA, 20 bp, Artificial Sequence
  Synthetic polynucleotide
aggtaacgtgggatagaaat

SEQ ID NO: 230 - DNA, 20 bp, Artificial Sequence
  Synthetic polynucleotide
ctgttactttactaagatgg

SEQ ID NO: 231 - DNA, 20 bp, Artificial Sequence
  Synthetic polynucleotide
cctctccttgttttgtcctg

SEQ ID NO: 232 - DNA, 20 bp, Artificial Sequence
  Synthetic polynucleotide
tagtggacatctgcatcact

SEQ ID NO: 233 - DNA, 20 bp, Artificial Sequence
  Synthetic polynucleotide
ggactgttactttactaaga

SEQ ID NO: 234 - DNA, 20 bp, Artificial Sequence
  Synthetic polynucleotide
actgaaggaattttcagaat

SEQ ID NO: 235 - DNA, 20 bp, Artificial Sequence
  Synthetic polynucleotide
ccatgaaacaaagatgcagt

SEQ ID NO: 236 - DNA, 20 bp, Artificial Sequence
  Synthetic polynucleotide
gagatggagactttatatgc

SEQ ID NO: 237 - DNA, 20 bp, Artificial Sequence
  Synthetic polynucleotide
ttttcagaattggagcaaag

SEQ ID NO: 238 - DNA, 20 bp, Artificial Sequence
  Synthetic polynucleotide
tcatagtctgggttgggaac

SEQ ID NO: 239 - DNA, 20 bp, Artificial Sequence
  Synthetic polynucleotide
ccgcaggacaaaacaaggag

SEQ ID NO: 240 - DNA, 20 bp, Artificial Sequence
  Synthetic polynucleotide
tctgggttgggaacaggtgg

SEQ ID NO: 241 - DNA, 20 bp, Artificial Sequence
  Synthetic polynucleotide
acacagacacgtgagtttat

SEQ ID NO: 242 - DNA, 20 bp, Artificial Sequence
  Synthetic polynucleotide
gccagcagacttactacttc

SEQ ID NO: 243 - DNA, 20 bp, Artificial Sequence
  Synthetic polynucleotide
tagtctgggttgggaacagg

SEQ ID NO: 244 - DNA, 20 bp, Artificial Sequence
  Synthetic polynucleotide
cgaacttttatctctacctg

SEQ ID NO: 245 - DNA, 20 bp, Artificial Sequence
  Synthetic polynucleotide
cgctcctcgtgtcacaggct

SEQ ID NO: 246 - DNA, 20 bp, Artificial Sequence
  Synthetic polynucleotide
ctactggagcaagaatagaa

SEQ ID NO: 247 - DNA, 20 bp, Artificial Sequence
  Synthetic polynucleotide
cgttacctcatagtctgggt

SEQ ID NO: 248 - DNA, 20 bp, Artificial Sequence
  Synthetic polynucleotide
agataaaagttcgcatcttc

SEQ ID NO: 249 - DNA, 20 bp, Artificial Sequence
  Synthetic polynucleotide
aaggccaagcctgtgacacg

SEQ ID NO: 250 - DNA, 20 bp, Artificial Sequence
  Synthetic polynucleotide
tggcggcaggcaaaggggta

SEQ ID NO: 251 - DNA, 20 bp, Artificial Sequence
  Synthetic polynucleotide
agggcatgtcaatattactg

SEQ ID NO: 252 - DNA, 20 bp, Artificial Sequence
  Synthetic polynucleotide
tcgtgtcacaggcttggcct

SEQ ID NO: 253 - DNA, 20 bp, Artificial Sequence
  Synthetic polynucleotide
tgcagttctcacacactgtg

SEQ ID NO: 254 - DNA, 20 bp, Artificial Sequence
  Synthetic polynucleotide
ggggggtggggtggggagag

SEQ ID NO: 255 - DNA, 20 bp, Artificial Sequence
  Synthetic polynucleotide
gatgaggatgataaaaacat

SEQ ID NO: 256 - DNA, 20 bp, Artificial Sequence
  Synthetic polynucleotide
catgcagttctcacacactg

SEQ ID NO: 257 - DNA, 20 bp, Artificial Sequence
  Synthetic polynucleotide
acgtgggatagaaatgggcc

SEQ ID NO: 258 - DNA, 20 bp, Artificial Sequence
  Synthetic polynucleotide
taccacctgaaaatgaaaaa

SEQ ID NO: 259 - DNA, 20 bp, Artificial Sequence
  Synthetic polynucleotide
tggcaggaatctcctctgac

SEQ ID NO: 260 - DNA, 20 bp, Artificial Sequence
  Synthetic polynucleotide
ctcacacactgtggggggtg

SEQ ID NO: 261 - DNA, 20 bp, Artificial Sequence
  Synthetic polynucleotide
gtgacacgaggagcgggtgc

SEQ ID NO: 262 - DNA, 20 bp, Artificial Sequence
  Synthetic polynucleotide
cagttctcacacactgtggg

SEQ ID NO: 263 - DNA, 20 bp, Artificial Sequence
  Synthetic polynucleotide
tgccatagtatttcagatcc

SEQ ID NO: 264 - DNA, 20 bp, Artificial Sequence
  Synthetic polynucleotide
tccagaagtagtaagtctgc

SEQ ID NO: 265 - DNA, 20 bp, Artificial Sequence
  Synthetic polynucleotide
ggtgctggcggcaggcaaag

SEQ ID NO: 266 - DNA, 20 bp, Artificial Sequence
  Synthetic polynucleotide
tcccacgttacctcatagtc

SEQ ID NO: 267 - DNA, 20 bp, Artificial Sequence
  Synthetic polynucleotide
cacagtgtgtgagaactgca

SEQ ID NO: 268 - DNA, 20 bp, Artificial Sequence
  Synthetic polynucleotide
cgactgcatctttgtttcat

SEQ ID NO: 269 - DNA, 20 bp, Artificial Sequence
  Synthetic polynucleotide
gggtgctggcggcaggcaaa

SEQ ID NO: 270 - DNA, 20 bp, Artificial Sequence
  Synthetic polynucleotide
gaggagcgggtgctggcggc

SEQ ID NO: 271 - DNA, 20 bp, Artificial Sequence
  Synthetic polynucleotide
ttgttttgtcctgcggagga

SEQ ID NO: 272 - DNA, 20 bp, Artificial Sequence
  Synthetic polynucleotide
ctccttgttttgtcctgcgg

SEQ ID NO: 273 - DNA, 20 bp, Artificial Sequence
  Synthetic polynucleotide
ccgactgcatctttgtttca

SEQ ID NO: 274 - DNA, 20 bp, Artificial Sequence
  Synthetic polynucleotide
tgtttccttttttcattttc

SEQ ID NO: 275 - DNA, 20 bp, Artificial Sequence
  Synthetic polynucleotide
ttccttttttcattttcagg

SEQ ID NO: 276 - DNA, 20 bp, Artificial Sequence
  Synthetic polynucleotide
aggctgtggagtccagtcag

SEQ ID NO: 277 - DNA, 20 bp, Artificial Sequence
  Synthetic polynucleotide
tggggggtggggtggggaga

SEQ ID NO: 278 - DNA, 20 bp, Artificial Sequence
  Synthetic polynucleotide
acactgtggggggtggggtg

SEQ ID NO: 279 - DNA, 20 bp, Artificial Sequence
  Synthetic polynucleotide
cacactgtggggggtggggt

SEQ ID NO: 280 - DNA, 20 bp, Artificial Sequence
  Synthetic polynucleotide
gtggggggtggggtggggag

SEQ ID NO: 281 - DNA, 20 bp, Artificial Sequence
  Synthetic polynucleotide
acacactgtggggggtgggg

SEQ ID NO: 282 - DNA, 20 bp, Artificial Sequence
  Synthetic polynucleotide
gcacccgctcctcgtgtcac

SEQ ID NO: 283 - DNA, 20 bp, Artificial Sequence
  Synthetic polynucleotide
gagcaagaatagaaaggcca

SEQ ID NO: 284 - RNA, 20 nt, Artificial Sequence
  Synthetic polynucleotide
gucagaggagauuccugcca

SEQ ID NO: 285 - RNA, 20 nt, Artificial Sequence
  Synthetic polynucleotide
agaggagauuccugccaagg

SEQ ID NO: 286 - RNA, 20 nt, Artificial Sequence
  Synthetic polynucleotide
gaacuuuuaucucuaccuga

SEQ ID NO: 287 - RNA, 20 nt, Artificial Sequence
  Synthetic polynucleotide
aagccugugacacgaggagc

SEQ ID NO: 288 - RNA, 20 nt, Artificial Sequence
  Synthetic polynucleotide
cauccuacucaccugauaag

SEQ ID NO: 289 - RNA, 20 nt, Artificial Sequence
  Synthetic polynucleotide
cuggauuaccucuugcccuc

SEQ ID NO: 290 - RNA, 20 nt, Artificial Sequence
  Synthetic polynucleotide
caugaaacaaagaugcaguc

SEQ ID NO: 291 - RNA, 20 nt, Artificial Sequence
  Synthetic polynucleotide
auuucagauccaggauacug

SEQ ID NO: 292 - RNA, 20 nt, Artificial Sequence
  Synthetic polynucleotide
ucagaggagauuccugccaa

SEQ ID NO: 293 - RNA, 20 nt, Artificial Sequence
  Synthetic polynucleotide
gcaguucucacacacugugg

SEQ ID NO: 294 - RNA, 20 nt, Artificial Sequence
  Synthetic polynucleotide
cacaaugauaaaaacauagg

SEQ ID NO: 295 - RNA, 20 nt, Artificial Sequence
  Synthetic polynucleotide
gugugagaacugcauggaga

SEQ ID NO: 296 - RNA, 20 nt, Artificial Sequence
  Synthetic polynucleotide
gauguccacuaugacaauug

SEQ ID NO: 297 - RNA, 20 nt, Artificial Sequence
  Synthetic polynucleotide
acucaccugauaagaggcag

SEQ ID NO: 298 - RNA, 20 nt, Artificial Sequence
  Synthetic polynucleotide
cucuuaucaggugaguagga

SEQ ID NO: 299 - RNA, 20 nt, Artificial Sequence
  Synthetic polynucleotide
uaucucuaccugagggcaag

SEQ ID NO: 300 - RNA, 20 nt, Artificial Sequence
  Synthetic polynucleotide
auccuggaucugaaauacua

SEQ ID NO: 301 - RNA, 20 nt, Artificial Sequence
  Synthetic polynucleotide
agauggagacuuuauaugcu

SEQ ID NO: 302 - RNA, 20 nt, Artificial Sequence
  Synthetic polynucleotide
cugccucuuaucaggugagu

SEQ ID NO: 303 - RNA, 20 nt, Artificial Sequence
  Synthetic polynucleotide
uauaugcuggggagaaagaa

SEQ ID NO: 304 - RNA, 20 nt, Artificial Sequence
  Synthetic polynucleotide
aguggacaucugcaucacug

SEQ ID NO: 305 - RNA, 20 nt, Artificial Sequence
  Synthetic polynucleotide
caagccugugacacgaggag

SEQ ID NO: 306 - RNA, 20 nt, Artificial Sequence
  Synthetic polynucleotide
guggacaucugcaucacugg

SEQ ID NO: 307 - RNA, 20 nt, Artificial Sequence
  Synthetic polynucleotide
gauggagacuuuauaugcug

SEQ ID NO: 308 - RNA, 20 nt, Artificial Sequence
  Synthetic polynucleotide
ucucacacacuguggggggu

SEQ ID NO: 309 - RNA, 20 nt, Artificial Sequence
  Synthetic polynucleotide
caggcaaagggguaaggcug

SEQ ID NO: 310 - RNA, 20 nt, Artificial Sequence
  Synthetic polynucleotide
guuaccucauagucuggguu

SEQ ID NO: 311 - RNA, 20 nt, Artificial Sequence
  Synthetic polynucleotide
cuucugguuugcuuccucug

SEQ ID NO: 312 - RNA, 20 nt, Artificial Sequence
  Synthetic polynucleotide
augcaguucucacacacugu

SEQ ID NO: 313 - RNA, 20 nt, Artificial Sequence
  Synthetic polynucleotide
cccacguuaccucauagucu

SEQ ID NO: 314 - RNA, 20 nt, Artificial Sequence
  Synthetic polynucleotide
uuccuccgcaggacaaaaca

SEQ ID NO: 315 - RNA, 20 nt, Artificial Sequence
  Synthetic polynucleotide
cugggccucugccucuuauc

SEQ ID NO: 316 - RNA, 20 nt, Artificial Sequence
  Synthetic polynucleotide
ggagauggaugugaugucgg

SEQ ID NO: 317 - RNA, 20 nt, Artificial Sequence
  Synthetic polynucleotide
uguucccaacccagacuaug

SEQ ID NO: 318 - RNA, 20 nt, Artificial Sequence
  Synthetic polynucleotide
acacgaggagcgggugcugg

SEQ ID NO: 319 - RNA, 20 nt, Artificial Sequence
  Synthetic polynucleotide
uuauaugcuggggagaaaga

SEQ ID NO: 320 - RNA, 20 nt, Artificial Sequence
  Synthetic polynucleotide
uuucagauccaggauacuga

SEQ ID NO: 321 - RNA, 20 nt, Artificial Sequence
  Synthetic polynucleotide
cauggagauggaugugaugu

SEQ ID NO: 322 - RNA, 20 nt, Artificial Sequence
  Synthetic polynucleotide
agaugcagucgggcacucac

SEQ ID NO: 323 - RNA, 20 nt, Artificial Sequence
  Synthetic polynucleotide
uauuaugucugcuaccccag

SEQ ID NO: 324 - RNA, 20 nt, Artificial Sequence
  Synthetic polynucleotide
guuuccccuccuuccuccgc

SEQ ID NO: 325 - RNA, 20 nt, Artificial Sequence
  Synthetic polynucleotide
uaaaaacauaggcagugaug

SEQ ID NO: 326 - RNA, 20 nt, Artificial Sequence
  Synthetic polynucleotide
gguggccacaauugucauag

SEQ ID NO: 327 - RNA, 20 nt, Artificial Sequence
  Synthetic polynucleotide
gcauauaaagucuccaucuc

SEQ ID NO: 328 - RNA, 20 nt, Artificial Sequence
  Synthetic polynucleotide
uauuacugugguuccagaga

SEQ ID NO: 329 - RNA, 20 nt, Artificial Sequence
  Synthetic polynucleotide
caacacaaugauaaaaacau

SEQ ID NO: 330 - RNA, 20 nt, Artificial Sequence
  Synthetic polynucleotide
guaauccaggucuccagaac

SEQ ID NO: 331 - RNA, 20 nt, Artificial Sequence
  Synthetic polynucleotide
cccagacuaugagguaacgu

SEQ ID NO: 332 - RNA, 20 nt, Artificial Sequence
  Synthetic polynucleotide
auaguggacaucugcaucac

SEQ ID NO: 333 - RNA, 20 nt, Artificial Sequence
  Synthetic polynucleotide
aucuucugguuugcuuccuc

SEQ ID NO: 334 - RNA, 20 nt, Artificial Sequence
  Synthetic polynucleotide
uuuuguccugcggaggaagg

SEQ ID NO: 335 - RNA, 20 nt, Artificial Sequence
  Synthetic polynucleotide
cugagggcaagagguaaucc

SEQ ID NO: 336 - RNA, 20 nt, Artificial Sequence
  Synthetic polynucleotide
uugacaugcccucaguaucc

SEQ ID NO: 337 - RNA, 20 nt, Artificial Sequence
  Synthetic polynucleotide
cagaggagauuccugccaag

SEQ ID NO: 338 - RNA, 20 nt, Artificial Sequence
  Synthetic polynucleotide
ugcugcugcugguuuacuac

SEQ ID NO: 339 - RNA, 20 nt, Artificial Sequence
  Synthetic polynucleotide
gagguaacgugggauagaaa

SEQ ID NO: 340 - RNA, 20 nt, Artificial Sequence
  Synthetic polynucleotide
acccagacuaugagguaacg

SEQ ID NO: 341 - RNA, 20 nt, Artificial Sequence
  Synthetic polynucleotide
cacugggggcuugcugcugc

SEQ ID NO: 342 - RNA, 20 nt, Artificial Sequence
  Synthetic polynucleotide
aucaggugaguaggauggag

SEQ ID NO: 343 - RNA, 20 nt, Artificial Sequence
  Synthetic polynucleotide
ggcacucacuggagaguucu

SEQ ID NO: 344 - RNA, 20 nt, Artificial Sequence
  Synthetic polynucleotide
uuuguccugcggaggaagga

SEQ ID NO: 345 - RNA, 20 nt, Artificial Sequence
  Synthetic polynucleotide
ugaggaucaccugucacuga

SEQ ID NO: 346 - RNA, 20 nt, Artificial Sequence
  Synthetic polynucleotide
uuacuuuacuaagauggcgg

SEQ ID NO: 347 - RNA, 20 nt, Artificial Sequence
  Synthetic polynucleotide
uaaaaacauaggcggugaug

SEQ ID NO: 348 - RNA, 20 nt, Artificial Sequence
  Synthetic polynucleotide
cugaaaauuccuucagugac

SEQ ID NO: 349 - RNA, 20 nt, Artificial Sequence
  Synthetic polynucleotide
uuguccugcggaggaaggag

SEQ ID NO: 350 - RNA, 20 nt, Artificial Sequence
  Synthetic polynucleotide
ucuucugguuugcuuccucu

SEQ ID NO: 351 - RNA, 20 nt, Artificial Sequence
  Synthetic polynucleotide
gggcacucacuggagaguuc

SEQ ID NO: 352 - RNA, 20 nt, Artificial Sequence
  Synthetic polynucleotide
uucucacacacugugggggg

SEQ ID NO: 353 - RNA, 20 nt, Artificial Sequence
  Synthetic polynucleotide
cgggugcuggcggcaggcaa

SEQ ID NO: 354 - RNA, 20 nt, Artificial Sequence
  Synthetic polynucleotide
agguaacgugggauagaaau

SEQ ID NO: 355 - RNA, 20 nt, Artificial Sequence
  Synthetic polynucleotide
cuguuacuuuacuaagaugg

SEQ ID NO: 356 - RNA, 20 nt, Artificial Sequence
  Synthetic polynucleotide
ccucuccuuguuuuguccug

SEQ ID NO: 357 - RNA, 20 nt, Artificial Sequence
  Synthetic polynucleotide
uaguggacaucugcaucacu

SEQ ID NO: 358 - RNA, 20 nt, Artificial Sequence
  Synthetic polynucleotide
ggacuguuacuuuacuaaga

SEQ ID NO: 359 - RNA, 20 nt, Artificial Sequence
  Synthetic polynucleotide
acugaaggaauuuucagaau

SEQ ID NO: 360 - RNA, 20 nt, Artificial Sequence
  Synthetic polynucleotide
ccaugaaacaaagaugcagu

SEQ ID NO: 361 - RNA, 20 nt, Artificial Sequence
  Synthetic polynucleotide
gagauggagacuuuauaugc

SEQ ID NO: 362 - RNA, 20 nt, Artificial Sequence
  Synthetic polynucleotide
uuuucagaauuggagcaaag

SEQ ID NO: 363 - RNA, 20 nt, Artificial Sequence
  Synthetic polynucleotide
ucauagucuggguugggaac

SEQ ID NO: 364 - RNA, 20 nt, Artificial Sequence
  Synthetic polynucleotide
ccgcaggacaaaacaaggag

SEQ ID NO: 365 - RNA, 20 nt, Artificial Sequence
  Synthetic polynucleotide
ucuggguugggaacaggugg

SEQ ID NO: 366 - RNA, 20 nt, Artificial Sequence
  Synthetic polynucleotide
acacagacacgugaguuuau

SEQ ID NO: 367 - RNA, 20 nt, Artificial Sequence
  Synthetic polynucleotide
gccagcagacuuacuacuuc

SEQ ID NO: 368 - RNA, 20 nt, Artificial Sequence
  Synthetic polynucleotide
uagucuggguugggaacagg

SEQ ID NO: 369 - RNA, 20 nt, Artificial Sequence
  Synthetic polynucleotide
cgaacuuuuaucucuaccug

SEQ ID NO: 370 - RNA, 20 nt, Artificial Sequence
  Synthetic polynucleotide
cgcuccucgugucacaggcu

SEQ ID NO: 371 - RNA, 20 nt, Artificial Sequence
  Synthetic polynucleotide
cuacuggagcaagaauagaa

SEQ ID NO: 372 - RNA, 20 nt, Artificial Sequence
  Synthetic polynucleotide
cguuaccucauagucugggu

SEQ ID NO: 373 - RNA, 20 nt, Artificial Sequence
  Synthetic polynucleotide
agauaaaaguucgcaucuuc

SEQ ID NO: 374 - RNA, 20 nt, Artificial Sequence
  Synthetic polynucleotide
aaggccaagccugugacacg

SEQ ID NO: 375 - RNA, 20 nt, Artificial Sequence
  Synthetic polynucleotide
uggcggcaggcaaaggggua

SEQ ID NO: 376 - RNA, 20 nt, Artificial Sequence
  Synthetic polynucleotide
agggcaugucaauauuacug

SEQ ID NO: 377 - RNA, 20 nt, Artificial Sequence
  Synthetic polynucleotide
ucgugucacaggcuuggccu

SEQ ID NO: 378 - RNA, 20 nt, Artificial Sequence
  Synthetic polynucleotide
ugcaguucucacacacugug

SEQ ID NO: 379 - RNA, 20 nt, Artificial Sequence
  Synthetic polynucleotide
ggggggugggguggggagag

SEQ ID NO: 380 - RNA, 20 nt, Artificial Sequence
  Synthetic polynucleotide
gaugaggaugauaaaaacau

SEQ ID NO: 381 - RNA, 20 nt, Artificial Sequence
  Synthetic polynucleotide
caugcaguucucacacacug

SEQ ID NO: 382 - RNA, 20 nt, Artificial Sequence
  Synthetic polynucleotide
acgugggauagaaaugggcc

SEQ ID NO: 383 - RNA, 20 nt, Artificial Sequence
  Synthetic polynucleotide
uaccaccugaaaaugaaaaa

SEQ ID NO: 384 - RNA, 20 nt, Artificial Sequence
  Synthetic polynucleotide
uggcaggaaucuccucugac

SEQ ID NO: 385 - RNA, 20 nt, Artificial Sequence
  Synthetic polynucleotide
cucacacacuguggggggug

SEQ ID NO: 386 - RNA, 20 nt, Artificial Sequence
  Synthetic polynucleotide
gugacacgaggagcgggugc

SEQ ID NO: 387 - RNA, 20 nt, Artificial Sequence
  Synthetic polynucleotide
caguucucacacacuguggg

SEQ ID NO: 388 - RNA, 20 nt, Artificial Sequence
  Synthetic polynucleotide
ugccauaguauuucagaucc

SEQ ID NO: 389 - RNA, 20 nt, Artificial Sequence
  Synthetic polynucleotide
uccagaaguaguaagucugc

SEQ ID NO: 390 - RNA, 20 nt, Artificial Sequence
  Synthetic polynucleotide
ggugcuggcggcaggcaaag

SEQ ID NO: 391 - RNA, 20 nt, Artificial Sequence
  Synthetic polynucleotide
ucccacguuaccucauaguc

SEQ ID NO: 392 - RNA, 20 nt, Artificial Sequence
  Synthetic polynucleotide
cacagugugugagaacugca

SEQ ID NO: 393 - RNA, 20 nt, Artificial Sequence
  Synthetic polynucleotide
cgacugcaucuuuguuucau

SEQ ID NO: 394 - RNA, 20 nt, Artificial Sequence
  Synthetic polynucleotide
gggugcuggcggcaggcaaa

SEQ ID NO: 395 - RNA, 20 nt, Artificial Sequence
  Synthetic polynucleotide
gaggagcgggugcuggcggc

SEQ ID NO: 396 - RNA, 20 nt, Artificial Sequence
  Synthetic polynucleotide
uuguuuuguccugcggagga

SEQ ID NO: 397 - RNA, 20 nt, Artificial Sequence
  Synthetic polynucleotide
cuccuuguuuuguccugcgg

SEQ ID NO: 398 - RNA, 20 nt, Artificial Sequence
  Synthetic polynucleotide
ccgacugcaucuuuguuuca

SEQ ID NO: 399 - RNA, 20 nt, Artificial Sequence
  Synthetic polynucleotide
uguuuccuuuuuucauuuuc

SEQ ID NO: 400 - RNA, 20 nt, Artificial Sequence
  Synthetic polynucleotide
uuccuuuuuucauuuucagg

SEQ ID NO: 401 - RNA, 20 nt, Artificial Sequence
  Synthetic polynucleotide
aggcuguggaguccagucag

SEQ ID NO: 402 - RNA, 20 nt, Artificial Sequence
  Synthetic polynucleotide
uggggggugggguggggaga

SEQ ID NO: 403 - RNA, 20 nt, Artificial Sequence
  Synthetic polynucleotide
acacugugggggguggggug

SEQ ID NO: 404 - RNA, 20 nt, Artificial Sequence
  Synthetic polynucleotide
cacacugugggggguggggu

SEQ ID NO: 405 - RNA, 20 nt, Artificial Sequence
  Synthetic polynucleotide
guggggggugggguggggag

SEQ ID NO: 406 - RNA, 20 nt, Artificial Sequence
  Synthetic polynucleotide
acacacuguggggggugggg

SEQ ID NO: 407 - RNA, 20 nt, Artificial Sequence
  Synthetic polynucleotide
gcacccgcuccucgugucac

SEQ ID NO: 408 - RNA, 20 nt, Artificial Sequence
  Synthetic polynucleotide
gagcaagaauagaaaggcca

SEQ ID NO: 409 - DNA, 20 bp, Artificial Sequence
  Synthetic polynucleotide
tcctgaagctgacagcattc

SEQ ID NO: 410 - DNA, 20 bp, Artificial Sequence
  Synthetic polynucleotide
cagtaagtcaacttcaatgt

SEQ ID NO: 411 - DNA, 20 bp, Artificial Sequence
  Synthetic polynucleotide
ggccgagatgtctcgctccg

SEQ ID NO: 412 - DNA, 20 bp, Artificial Sequence
  Synthetic polynucleotide
acaaagtcacatggttcaca

SEQ ID NO: 413 - DNA, 20 bp, Artificial Sequence
  Synthetic polynucleotide
cgcgagcacagctaaggcca

SEQ ID NO: 414 - DNA, 20 bp, Artificial Sequence
  Synthetic polynucleotide
catactcatctttttcagtg

SEQ ID NO: 415 - DNA, 20 bp, Artificial Sequence
  Synthetic polynucleotide
actctctctttctggcctgg

SEQ ID NO: 416 - DNA, 20 bp, Artificial Sequence
  Synthetic polynucleotide
ctcgcgctactctctctttc

SEQ ID NO: 417 - DNA, 20 bp, Artificial Sequence
  Synthetic polynucleotide
gctactctctctttctggcc

SEQ ID NO: 418 - DNA, 20 bp, Artificial Sequence
  Synthetic polynucleotide
tctctcctaccctcccgctc

SEQ ID NO: 419 - DNA, 20 bp, Artificial Sequence
  Synthetic polynucleotide
cagcccaagatagttaagtg

SEQ ID NO: 420 - DNA, 20 bp, Artificial Sequence
  Synthetic polynucleotide
tcacgtcatccagcagagaa

SEQ ID NO: 421 - DNA, 20 bp, Artificial Sequence
  Synthetic polynucleotide
ttaccccacttaactatctt

SEQ ID NO: 422 - DNA, 20 bp, Artificial Sequence
  Synthetic polynucleotide
ggccacggagcgagacatct

SEQ ID NO: 423 - DNA, 20 bp, Artificial Sequence
  Synthetic polynucleotide
cttaccccacttaactatct

SEQ ID NO: 424 - DNA, 20 bp, Artificial Sequence
  Synthetic polynucleotide
ggcatactcatctttttcag

SEQ ID NO: 425 - DNA, 20 bp, Artificial Sequence
  Synthetic polynucleotide
tataagtggaggcgtcgcgc

SEQ ID NO: 426 - DNA, 20 bp, Artificial Sequence
  Synthetic polynucleotide
gcccgaatgctgtcagcttc

SEQ ID NO: 427 - DNA, 20 bp, Artificial Sequence
  Synthetic polynucleotide
gaagttgacttactgaagaa

SEQ ID NO: 428 - DNA, 20 bp, Artificial Sequence
  Synthetic polynucleotide
gaggaaggaccagagcggga

SEQ ID NO: 429 - DNA, 20 bp, Artificial Sequence
  Synthetic polynucleotide
aagtggaggcgtcgcgctgg

SEQ ID NO: 430 - DNA, 20 bp, Artificial Sequence
  Synthetic polynucleotide
actcacgctggatagcctcc

SEQ ID NO: 431 - DNA, 20 bp, Artificial Sequence
  Synthetic polynucleotide
gagtagcgcgagcacagcta

SEQ ID NO: 432 - DNA, 20 bp, Artificial Sequence
  Synthetic polynucleotide
agggtaggagagactcacgc

SEQ ID NO: 433 - DNA, 20 bp, Artificial Sequence
  Synthetic polynucleotide
ttcagacttgtctttcagca

SEQ ID NO: 434 - DNA, 20 bp, Artificial Sequence
  Synthetic polynucleotide
cacagcccaagatagttaag

SEQ ID NO: 435 - DNA, 20 bp, Artificial Sequence
  Synthetic polynucleotide
ttggagtacctgaggaatat

SEQ ID NO: 436 - DNA, 20 bp, Artificial Sequence
  Synthetic polynucleotide
aaggaccagagcgggagggt

SEQ ID NO: 437 - DNA, 20 bp, Artificial Sequence
  Synthetic polynucleotide
agaggaaggaccagagcggg

SEQ ID NO: 438 - DNA, 20 bp, Artificial Sequence
  Synthetic polynucleotide
aagtcaacttcaatgtcgga

SEQ ID NO: 439 - DNA, 20 bp, Artificial Sequence
  Synthetic polynucleotide
agtggaggcgtcgcgctggc

SEQ ID NO: 440 - DNA, 20 bp, Artificial Sequence
  Synthetic polynucleotide
tggagtacctgaggaatatc

SEQ ID NO: 441 - DNA, 20 bp, Artificial Sequence
  Synthetic polynucleotide
acagcccaagatagttaagt

SEQ ID NO: 442 - DNA, 20 bp, Artificial Sequence
  Synthetic polynucleotide
cgtgagtaaacctgaatctt

SEQ ID NO: 443 - DNA, 20 bp, Artificial Sequence
  Synthetic polynucleotide
tggagagagaattgaaaaag

SEQ ID NO: 444 - DNA, 20 bp, Artificial Sequence
  Synthetic polynucleotide
atactcatctttttcagtgg

SEQ ID NO: 445 - DNA, 20 bp, Artificial Sequence
  Synthetic polynucleotide
agtcacatggttcacacggc

SEQ ID NO: 446 - DNA, 20 bp, Artificial Sequence
  Synthetic polynucleotide
cacgcgtttaatataagtgg

SEQ ID NO: 447 - DNA, 20 bp, Artificial Sequence
  Synthetic polynucleotide
ctcaggtactccaaagattc

SEQ ID NO: 448 - DNA, 20 bp, Artificial Sequence
  Synthetic polynucleotide
tttgactttccattctctgc

SEQ ID NO: 449 - DNA, 20 bp, Artificial Sequence
  Synthetic polynucleotide
acccagacacatagcaattc

SEQ ID NO: 450 - DNA, 20 bp, Artificial Sequence
  Synthetic polynucleotide
tgggctgtgacaaagtcaca

SEQ ID NO: 451 - DNA, 20 bp, Artificial Sequence
  Synthetic polynucleotide
ctgaatctttggagtacctg

SEQ ID NO: 452 - DNA, 20 bp, Artificial Sequence
  Synthetic polynucleotide
ttcctgaattgctatgtgtc

SEQ ID NO: 453 - DNA, 20 bp, Artificial Sequence
  Synthetic polynucleotide
acttgtctttcagcaaggac

SEQ ID NO: 454 - DNA, 20 bp, Artificial Sequence
  Synthetic polynucleotide
ttcctgaagctgacagcatt

SEQ ID NO: 455 - DNA, 20 bp, Artificial Sequence
  Synthetic polynucleotide
gcatactcatctttttcagt

SEQ ID NO: 456 - DNA, 20 bp, Artificial Sequence
  Synthetic polynucleotide
tcctgaattgctatgtgtct

SEQ ID NO: 457 - DNA, 20 bp, Artificial Sequence
  Synthetic polynucleotide
tcatagatcgagacatgtaa

SEQ ID NO: 458 - RNA, 20 nt, Artificial Sequence
  Synthetic polynucleotide
uccugaagcugacagcauuc

SEQ ID NO: 459 - RNA, 20 nt, Artificial Sequence
  Synthetic polynucleotide
caguaagucaacuucaaugu

SEQ ID NO: 460 - RNA, 20 nt, Artificial Sequence
  Synthetic polynucleotide
ggccgagaugucucgcuccg

SEQ ID NO: 461 - RNA, 20 nt, Artificial Sequence
  Synthetic polynucleotide
acaaagucacaugguucaca

SEQ ID NO: 462 - RNA, 20 nt, Artificial Sequence
  Synthetic polynucleotide
cgcgagcacagcuaaggcca

SEQ ID NO: 463 - RNA, 20 nt, Artificial Sequence
  Synthetic polynucleotide
cauacucaucuuuuucagug

SEQ ID NO: 464 - RNA, 20 nt, Artificial Sequence
  Synthetic polynucleotide
acucucucuuucuggccugg

SEQ ID NO: 465 - RNA, 20 nt, Artificial Sequence
  Synthetic polynucleotide
cucgcgcuacucucucuuuc

SEQ ID NO: 466 - RNA, 20 nt, Artificial Sequence
  Synthetic polynucleotide
gcuacucucucuuucuggcc

SEQ ID NO: 467 - RNA, 20 nt, Artificial Sequence
  Synthetic polynucleotide
ucucuccuacccucccgcuc

SEQ ID NO: 468 - RNA, 20 nt, Artificial Sequence
  Synthetic polynucleotide
cagcccaagauaguuaagug

SEQ ID NO: 469 - RNA, 20 nt, Artificial Sequence
  Synthetic polynucleotide
ucacgucauccagcagagaa

SEQ ID NO: 470 - RNA, 20 nt, Artificial Sequence
  Synthetic polynucleotide
uuaccccacuuaacuaucuu

SEQ ID NO: 471 - RNA, 20 nt, Artificial Sequence
  Synthetic polynucleotide
ggccacggagcgagacaucu

SEQ ID NO: 472 - RNA, 20 nt, Artificial Sequence
  Synthetic polynucleotide
cuuaccccacuuaacuaucu

SEQ ID NO: 473 - RNA, 20 nt, Artificial Sequence
  Synthetic polynucleotide
ggcauacucaucuuuuucag

SEQ ID NO: 474 - RNA, 20 nt, Artificial Sequence
  Synthetic polynucleotide
uauaaguggaggcgucgcgc

SEQ ID NO: 475 - RNA, 20 nt, Artificial Sequence
  Synthetic polynucleotide
gcccgaaugcugucagcuuc

SEQ ID NO: 476 - RNA, 20 nt, Artificial Sequence
  Synthetic polynucleotide
gaaguugacuuacugaagaa

SEQ ID NO: 477 - RNA, 20 nt, Artificial Sequence
  Synthetic polynucleotide
gaggaaggaccagagcggga

SEQ ID NO: 478 - RNA, 20 nt, Artificial Sequence
  Synthetic polynucleotide
aaguggaggcgucgcgcugg

SEQ ID NO: 479 - RNA, 20 nt, Artificial Sequence
  Synthetic polynucleotide
acucacgcuggauagccucc

SEQ ID NO: 480 - RNA, 20 nt, Artificial Sequence
  Synthetic polynucleotide
gaguagcgcgagcacagcua

SEQ ID NO: 481 - RNA, 20 nt, Artificial Sequence
  Synthetic polynucleotide
aggguaggagagacucacgc

SEQ ID NO: 482 - RNA, 20 nt, Artificial Sequence
  Synthetic polynucleotide
uucagacuugucuuucagca

SEQ ID NO: 483 - RNA, 20 nt, Artificial Sequence
  Synthetic polynucleotide
cacagcccaagauaguuaag

SEQ ID NO: 484 - RNA, 20 nt, Artificial Sequence
  Synthetic polynucleotide
uuggaguaccugaggaauau

SEQ ID NO: 485 - RNA, 20 nt, Artificial Sequence
  Synthetic polynucleotide
aaggaccagagcgggagggu

SEQ ID NO: 486 - RNA, 20 nt, Artificial Sequence
  Synthetic polynucleotide
agaggaaggaccagagcggg

SEQ ID NO: 487 - RNA, 20 nt, Artificial Sequence
  Synthetic polynucleotide
aagucaacuucaaugucgga

SEQ ID NO: 488 - RNA, 20 nt, Artificial Sequence
  Synthetic polynucleotide
aguggaggcgucgcgcuggc

SEQ ID NO: 489 - RNA, 20 nt, Artificial Sequence
  Synthetic polynucleotide
uggaguaccugaggaauauc

SEQ ID NO: 490 - RNA, 20 nt, Artificial Sequence
  Synthetic polynucleotide
acagcccaagauaguuaagu

SEQ ID NO: 491 - RNA, 20 nt, Artificial Sequence
  Synthetic polynucleotide
cgugaguaaaccugaaucuu

SEQ ID NO: 492 - RNA, 20 nt, Artificial Sequence
  Synthetic polynucleotide
uggagagagaauugaaaaag

SEQ ID NO: 493 - RNA, 20 nt, Artificial Sequence
  Synthetic polynucleotide
auacucaucuuuuucagugg

SEQ ID NO: 494 - RNA, 20 nt, Artificial Sequence
  Synthetic polynucleotide
agucacaugguucacacggc

SEQ ID NO: 495 - RNA, 20 nt, Artificial Sequence
  Synthetic polynucleotide
cacgcguuuaauauaagugg

SEQ ID NO: 496 - RNA, 20 nt, Artificial Sequence
  Synthetic polynucleotide
cucagguacuccaaagauuc

SEQ ID NO: 497 - RNA, 20 nt, Artificial Sequence
  Synthetic polynucleotide
uuugacuuuccauucucugc

SEQ ID NO: 498 - RNA, 20 nt, Artificial Sequence
  Synthetic polynucleotide
acccagacacauagcaauuc

SEQ ID NO: 499 - RNA, 20 nt, Artificial Sequence
  Synthetic polynucleotide
ugggcugugacaaagucaca

SEQ ID NO: 500 - RNA, 20 nt, Artificial Sequence
  Synthetic polynucleotide
cugaaucuuuggaguaccug

SEQ ID NO: 501 - RNA, 20 nt, Artificial Sequence
  Synthetic polynucleotide
uuccugaauugcuauguguc

SEQ ID NO: 502 - RNA, 20 nt, Artificial Sequence
  Synthetic polynucleotide
acuugucuuucagcaaggac

SEQ ID NO: 503 - RNA, 20 nt, Artificial Sequence
  Synthetic polynucleotide
uuccugaagcugacagcauu

SEQ ID NO: 504 - RNA, 20 nt, Artificial Sequence
  Synthetic polynucleotide
gcauacucaucuuuuucagu

SEQ ID NO: 505 - RNA, 20 nt, Artificial Sequence
  Synthetic polynucleotide
uccugaauugcuaugugucu

SEQ ID NO: 506 - RNA, 20 nt, Artificial Sequence
  Synthetic polynucleotide
ucauagaucgagacauguaa

SEQ ID NO: 507 - DNA, 20 bp, Artificial Sequence
  Synthetic polynucleotide
ctggggccgcggcaagtctg

SEQ ID NO: 508 - DNA, 20 bp, Artificial Sequence
  Synthetic polynucleotide
ctccagtcggttcctcacag

SEQ ID NO: 509 - DNA, 20 bp, Artificial Sequence
  Synthetic polynucleotide
agaggtcttggattcctgct

SEQ ID NO: 510 - DNA, 20 bp, Artificial Sequence
  Synthetic polynucleotide
gccctgccggtccttttcag

SEQ ID NO: 511 - DNA, 20 bp, Artificial Sequence
  Synthetic polynucleotide
agactccgggagctgctgcc

SEQ ID NO: 512 - DNA, 20 bp, Artificial Sequence
  Synthetic polynucleotide
gtcacctaccgctgttcccc

SEQ ID NO: 513 - DNA, 20 bp, Artificial Sequence
  Synthetic polynucleotide
gcctggctccacgccctgct

SEQ ID NO: 514 - DNA, 20 bp, Artificial Sequence
  Synthetic polynucleotide
ctgggactctccccgaagtg

SEQ ID NO: 515 - DNA, 20 bp, Artificial Sequence
  Synthetic polynucleotide
gagctgccacagacttgccg

SEQ ID NO: 516 - DNA, 20 bp, Artificial Sequence
  Synthetic polynucleotide
cttggatgccccaggcagtt

SEQ ID NO: 517 - DNA, 20 bp, Artificial Sequence
  Synthetic polynucleotide
tctgcaagtcctgagttgca

SEQ ID NO: 518 - DNA, 20 bp, Artificial Sequence
  Synthetic polynucleotide
gggataccggaagagaccag

SEQ ID NO: 519 - DNA, 20 bp, Artificial Sequence
  Synthetic polynucleotide
ggtcacctaccgctgttccc

SEQ ID NO: 520 - DNA, 20 bp, Artificial Sequence
  Synthetic polynucleotide
acaatgctcagtcacctcac

SEQ ID NO: 521 - DNA, 20 bp, Artificial Sequence
  Synthetic polynucleotide
ggagcccggggaacagcggt

SEQ ID NO: 522 - DNA, 20 bp, Artificial Sequence
  Synthetic polynucleotide
ggccactgtgaggaaccgac

SEQ ID NO: 523 - DNA, 20 bp, Artificial Sequence
  Synthetic polynucleotide
tggagatgccagcagaagtt

SEQ ID NO: 524 - DNA, 20 bp, Artificial Sequence
  Synthetic polynucleotide
ataggaccagatgaagtgat

SEQ ID NO: 525 - DNA, 20 bp, Artificial Sequence
  Synthetic polynucleotide
cttctgagctgggcatccga

SEQ ID NO: 526 - DNA, 20 bp, Artificial Sequence
  Synthetic polynucleotide
tcctacctgtcagagcccca

SEQ ID NO: 527 - DNA, 20 bp, Artificial Sequence
  Synthetic polynucleotide
gcccagaaaaggacaatcaa

SEQ ID NO: 528 - DNA, 20 bp, Artificial Sequence
  Synthetic polynucleotide
gaggtggtttgccactttca

SEQ ID NO: 529 - DNA, 20 bp, Artificial Sequence
  Synthetic polynucleotide
gaagctgagggcacgaggag

SEQ ID NO: 530 - DNA, 20 bp, Artificial Sequence
  Synthetic polynucleotide
ggcttatgccaatatcggtg

SEQ ID NO: 531 - DNA, 20 bp, Artificial Sequence
  Synthetic polynucleotide
ctcctctgatgctggcccta

SEQ ID NO: 532 - DNA, 20 bp, Artificial Sequence
  Synthetic polynucleotide
ggataccggaagagaccaga

SEQ ID NO: 533 - DNA, 20 bp, Artificial Sequence
  Synthetic polynucleotide
ggacaagctccctgcaactc

SEQ ID NO: 534 - DNA, 20 bp, Artificial Sequence
  Synthetic polynucleotide
catccatggaaggtacctga

SEQ ID NO: 535 - DNA, 20 bp, Artificial Sequence
  Synthetic polynucleotide
tagctcagttagctcatctc

SEQ ID NO: 536 - DNA, 20 bp, Artificial Sequence
  Synthetic polynucleotide
gatattggcataagcctccc

SEQ ID NO: 537 - DNA, 20 bp, Artificial Sequence
  Synthetic polynucleotide
tagtgatgaggctagtgatg

SEQ ID NO: 538 - DNA, 20 bp, Artificial Sequence
  Synthetic polynucleotide
gaagtggcatcccaactgcc

SEQ ID NO: 539 - DNA, 20 bp, Artificial Sequence
  Synthetic polynucleotide
gctcagttagctcatctcag

SEQ ID NO: 540 - DNA, 20 bp, Artificial Sequence
  Synthetic polynucleotide
aggtgatgaagagaccaggg

SEQ ID NO: 541 - DNA, 20 bp, Artificial Sequence
  Synthetic polynucleotide
gaggccaccagcagcgcgcg

SEQ ID NO: 542 - DNA, 20 bp, Artificial Sequence
  Synthetic polynucleotide
ttctaggggccccaactcca

SEQ ID NO: 543 - DNA, 20 bp, Artificial Sequence
  Synthetic polynucleotide
agtctcctctgtaaccccta

SEQ ID NO: 544 - DNA, 20 bp, Artificial Sequence
  Synthetic polynucleotide
aagtggcaaaccacctccga

SEQ ID NO: 545 - DNA, 20 bp, Artificial Sequence
  Synthetic polynucleotide
ttttaccttggggctctgac

SEQ ID NO: 546 - DNA, 20 bp, Artificial Sequence
  Synthetic polynucleotide
ggtccatctggtcatagaag

SEQ ID NO: 547 - DNA, 20 bp, Artificial Sequence
  Synthetic polynucleotide
gagcaaccaagcacctactg

SEQ ID NO: 548 - DNA, 20 bp, Artificial Sequence
  Synthetic polynucleotide
tcgtgccctcagcttcccca

SEQ ID NO: 549 - DNA, 20 bp, Artificial Sequence
  Synthetic polynucleotide
acttctgataaagcacgtgg

SEQ ID NO: 550 - DNA, 20 bp, Artificial Sequence
  Synthetic polynucleotide
atggagttggggcccctaga

SEQ ID NO: 551 - DNA, 20 bp, Artificial Sequence
  Synthetic polynucleotide
agcccagaaaaggacaatca

SEQ ID NO: 552 - DNA, 20 bp, Artificial Sequence
  Synthetic polynucleotide
taggggccccaactccatgg

SEQ ID NO: 553 - DNA, 20 bp, Artificial Sequence
  Synthetic polynucleotide
gtggcacactgtgagctgcc

SEQ ID NO: 554 - DNA, 20 bp, Artificial Sequence
  Synthetic polynucleotide
gaagcacctgagcccagaaa

SEQ ID NO: 555 - DNA, 20 bp, Artificial Sequence
  Synthetic polynucleotide
gtcagagccccaaggtaaaa

SEQ ID NO: 556 - DNA, 20 bp, Artificial Sequence
  Synthetic polynucleotide
gctccaggtagccaccttct

SEQ ID NO: 557 - DNA, 20 bp, Artificial Sequence
  Synthetic polynucleotide
ctttcacggttggactgagt

SEQ ID NO: 558 - DNA, 20 bp, Artificial Sequence
  Synthetic polynucleotide
gccacttctgataaagcacg

SEQ ID NO: 559 - DNA, 20 bp, Artificial Sequence
  Synthetic polynucleotide
aatccctcaggtaccttcca

SEQ ID NO: 560 - DNA, 20 bp, Artificial Sequence
  Synthetic polynucleotide
gtctgtggcagctcgtccgc

SEQ ID NO: 561 - DNA, 20 bp, Artificial Sequence
  Synthetic polynucleotide
acactgtgagctgcctggga

SEQ ID NO: 562 - DNA, 20 bp, Artificial Sequence
  Synthetic polynucleotide
aaagtggcaaaccacctccg

SEQ ID NO: 563 - DNA, 20 bp, Artificial Sequence
  Synthetic polynucleotide
aggcatccttggggaagctg

SEQ ID NO: 564 - DNA, 20 bp, Artificial Sequence
  Synthetic polynucleotide
actcagtccaaccgtgaaag

SEQ ID NO: 565 - DNA, 20 bp, Artificial Sequence
  Synthetic polynucleotide
agggacctcttggatgcccc

SEQ ID NO: 566 - DNA, 20 bp, Artificial Sequence
  Synthetic polynucleotide
agcaaggctaggttggatca

SEQ ID NO: 567 - DNA, 20 bp, Artificial Sequence
  Synthetic polynucleotide
gcccttgattgtccttttct

SEQ ID NO: 568 - DNA, 20 bp, Artificial Sequence
  Synthetic polynucleotide
ggaaggtgatgaagagacca

SEQ ID NO: 569 - DNA, 20 bp, Artificial Sequence
  Synthetic polynucleotide
accacgtgctttatcagaag

SEQ ID NO: 570 - DNA, 20 bp, Artificial Sequence
  Synthetic polynucleotide
accttggggctctgacaggt

SEQ ID NO: 571 - DNA, 20 bp, Artificial Sequence
  Synthetic polynucleotide
aggtaggacccagcagggcg

SEQ ID NO: 572 - DNA, 20 bp, Artificial Sequence
  Synthetic polynucleotide
gggcatccgaaggcatcctt

SEQ ID NO: 573 - DNA, 20 bp, Artificial Sequence
  Synthetic polynucleotide
cagtggccagccccacttcg

SEQ ID NO: 574 - DNA, 20 bp, Artificial Sequence
  Synthetic polynucleotide
cccagccaggcagcagctcc

SEQ ID NO: 575 - DNA, 20 bp, Artificial Sequence
  Synthetic polynucleotide
ggcatccgaaggcatccttg

SEQ ID NO: 576 - DNA, 20 bp, Artificial Sequence
  Synthetic polynucleotide
gcctgggactctccccgaag

SEQ ID NO: 577 - DNA, 20 bp, Artificial Sequence
  Synthetic polynucleotide
cactgtgaggaaccgactgg

SEQ ID NO: 578 - DNA, 20 bp, Artificial Sequence
  Synthetic polynucleotide
aaaagaactgcggggaggcg

SEQ ID NO: 579 - DNA, 20 bp, Artificial Sequence
  Synthetic polynucleotide
tgagcattgtcttccctccc

SEQ ID NO: 580 - DNA, 20 bp, Artificial Sequence
  Synthetic polynucleotide
cctcaggtaccttccatgga

SEQ ID NO: 581 - DNA, 20 bp, Artificial Sequence
  Synthetic polynucleotide
cacactgtgagctgcctggg

SEQ ID NO: 582 - DNA, 20 bp, Artificial Sequence
  Synthetic polynucleotide
cttctccagccaggtccatc

SEQ ID NO: 583 - DNA, 20 bp, Artificial Sequence
  Synthetic polynucleotide
ggaagagaccagagggagga

SEQ ID NO: 584 - DNA, 20 bp, Artificial Sequence
  Synthetic polynucleotide
agccaggcaacgcattgtgt

SEQ ID NO: 585 - DNA, 20 bp, Artificial Sequence
  Synthetic polynucleotide
aaggctaggttggatcaggg

SEQ ID NO: 586 - DNA, 20 bp, Artificial Sequence
  Synthetic polynucleotide
cctgggactctccccgaagt

SEQ ID NO: 587 - DNA, 20 bp, Artificial Sequence
  Synthetic polynucleotide
acagtgtgccaccatggagt

SEQ ID NO: 588 - DNA, 20 bp, Artificial Sequence
  Synthetic polynucleotide
ggctaggttggatcagggag

SEQ ID NO: 589 - DNA, 20 bp, Artificial Sequence
  Synthetic polynucleotide
ctccaaggcatgagactttg

SEQ ID NO: 590 - DNA, 20 bp, Artificial Sequence
  Synthetic polynucleotide
gcccctagaaggtggctacc

SEQ ID NO: 591 - DNA, 20 bp, Artificial Sequence
  Synthetic polynucleotide
ctgacaggtaggacccagca

SEQ ID NO: 592 - DNA, 20 bp, Artificial Sequence
  Synthetic polynucleotide
gcagggctcttgccacggct

SEQ ID NO: 593 - DNA, 20 bp, Artificial Sequence
  Synthetic polynucleotide
gagccccaaggtaaaaaggc

SEQ ID NO: 594 - DNA, 20 bp, Artificial Sequence
  Synthetic polynucleotide
gctattcactcctctgatgc

SEQ ID NO: 595 - DNA, 20 bp, Artificial Sequence
  Synthetic polynucleotide
catcgctgttaagaagctcc

SEQ ID NO: 596 - DNA, 20 bp, Artificial Sequence
  Synthetic polynucleotide
gggtgtggtcatggtaacac

SEQ ID NO: 597 - DNA, 20 bp, Artificial Sequence
  Synthetic polynucleotide
aagtggcatcccaactgcct

SEQ ID NO: 598 - DNA, 20 bp, Artificial Sequence
  Synthetic polynucleotide
gggaagctgagggcacgagg

SEQ ID NO: 599 - DNA, 20 bp, Artificial Sequence
  Synthetic polynucleotide
cttctatgaccagatggacc

SEQ ID NO: 600 - DNA, 20 bp, Artificial Sequence
  Synthetic polynucleotide
ctccaggtagccaccttcta

SEQ ID NO: 601 - DNA, 20 bp, Artificial Sequence
  Synthetic polynucleotide
ggaagctgagggcacgagga

SEQ ID NO: 602 - DNA, 20 bp, Artificial Sequence
  Synthetic polynucleotide
caatgctcagtcacctcaca

SEQ ID NO: 603 - DNA, 20 bp, Artificial Sequence
  Synthetic polynucleotide
ctttcccggcctttttacct

SEQ ID NO: 604 - DNA, 20 bp, Artificial Sequence
  Synthetic polynucleotide
gctgaactggtcgcagttga

SEQ ID NO: 605 - DNA, 20 bp, Artificial Sequence
  Synthetic polynucleotide
ttgcagatcacttgcccaag

SEQ ID NO: 606 - DNA, 20 bp, Artificial Sequence
  Synthetic polynucleotide
ctcctccctctggtctcttc

SEQ ID NO: 607 - DNA, 20 bp, Artificial Sequence
  Synthetic polynucleotide
ttcctacacaatgcgttgcc

SEQ ID NO: 608 - DNA, 20 bp, Artificial Sequence
  Synthetic polynucleotide
ttggggaagctgagggcacg

SEQ ID NO: 609 - DNA, 20 bp, Artificial Sequence
  Synthetic polynucleotide
tccaggtagccaccttctag

SEQ ID NO: 610 - DNA, 20 bp, Artificial Sequence
  Synthetic polynucleotide
tgaagtgatcggtgagagta

SEQ ID NO: 611 - DNA, 20 bp, Artificial Sequence
  Synthetic polynucleotide
cctctttccaacaccctgtg

SEQ ID NO: 612 - DNA, 20 bp, Artificial Sequence
  Synthetic polynucleotide
acctctgaaaaggaccggca

SEQ ID NO: 613 - DNA, 20 bp, Artificial Sequence
  Synthetic polynucleotide
gtgaggaaccgactggaggc

SEQ ID NO: 614 - DNA, 20 bp, Artificial Sequence
  Synthetic polynucleotide
gggccatgtgccctcggagg

SEQ ID NO: 615 - DNA, 20 bp, Artificial Sequence
  Synthetic polynucleotide
aggctaggttggatcaggga

SEQ ID NO: 616 - DNA, 20 bp, Artificial Sequence
  Synthetic polynucleotide
ttcccggcctttttaccttg

SEQ ID NO: 617 - DNA, 20 bp, Artificial Sequence
  Synthetic polynucleotide
cagaggtcttggattcctgc

SEQ ID NO: 618 - DNA, 20 bp, Artificial Sequence
  Synthetic polynucleotide
atagaagtggtagaggcaca

SEQ ID NO: 619 - DNA, 20 bp, Artificial Sequence
  Synthetic polynucleotide
ttctgggaggaaaagtccct

SEQ ID NO: 620 - DNA, 20 bp, Artificial Sequence
  Synthetic polynucleotide
tctgacaggtaggacccagc

SEQ ID NO: 621 - DNA, 20 bp, Artificial Sequence
  Synthetic polynucleotide
gcagttgatggtgtctgtgt

SEQ ID NO: 622 - DNA, 20 bp, Artificial Sequence
  Synthetic polynucleotide
cctcacagggtgttggaaag

SEQ ID NO: 623 - DNA, 20 bp, Artificial Sequence
  Synthetic polynucleotide
gaccggcagggctcttgcca

SEQ ID NO: 624 - DNA, 20 bp, Artificial Sequence
  Synthetic polynucleotide
taccggaagagaccagaggg

SEQ ID NO: 625 - DNA, 20 bp, Artificial Sequence
  Synthetic polynucleotide
tgggcatccgaaggcatcct

SEQ ID NO: 626 - DNA, 20 bp, Artificial Sequence
  Synthetic polynucleotide
gaggaggggctgccagactc

SEQ ID NO: 627 - DNA, 20 bp, Artificial Sequence
  Synthetic polynucleotide
gaaatttccttcttcatcca

SEQ ID NO: 628 - DNA, 20 bp, Artificial Sequence
  Synthetic polynucleotide
agattgagctctactcaggt

SEQ ID NO: 629 - DNA, 20 bp, Artificial Sequence
  Synthetic polynucleotide
cagctcacagtgtgccacca

SEQ ID NO: 630 - DNA, 20 bp, Artificial Sequence
  Synthetic polynucleotide
ctaccacttctatgaccaga

SEQ ID NO: 631 - DNA, 20 bp, Artificial Sequence
  Synthetic polynucleotide
cacctcaaagtctcatgcct

SEQ ID NO: 632 - DNA, 20 bp, Artificial Sequence
  Synthetic polynucleotide
aggctgttgtgtgacatgga

SEQ ID NO: 633 - DNA, 20 bp, Artificial Sequence
  Synthetic polynucleotide
tctggtcatagaagtggtag

SEQ ID NO: 634 - DNA, 20 bp, Artificial Sequence
  Synthetic polynucleotide
agtgtgccaccatggagttg

SEQ ID NO: 635 - DNA, 20 bp, Artificial Sequence
  Synthetic polynucleotide
cagtgtgccaccatggagtt

SEQ ID NO: 636 - DNA, 20 bp, Artificial Sequence
  Synthetic polynucleotide
cacacaacagcctgctgaac

SEQ ID NO: 637 - DNA, 20 bp, Artificial Sequence
  Synthetic polynucleotide
gactctccccgaagtggggc

SEQ ID NO: 638 - DNA, 20 bp, Artificial Sequence
  Synthetic polynucleotide
cagggctcttgccacggctg

SEQ ID NO: 639 - DNA, 20 bp, Artificial Sequence
  Synthetic polynucleotide
aggaggggctgccagactcc

SEQ ID NO: 640 - DNA, 20 bp, Artificial Sequence
  Synthetic polynucleotide
tggtttgccactttcacggt

SEQ ID NO: 641 - DNA, 20 bp, Artificial Sequence
  Synthetic polynucleotide
tttctcaaagtagagcacat

SEQ ID NO: 642 - DNA, 20 bp, Artificial Sequence
  Synthetic polynucleotide
acttgccgcggccccagagc

SEQ ID NO: 643 - DNA, 20 bp, Artificial Sequence
  Synthetic polynucleotide
tcagtcacctcacagggtgt

SEQ ID NO: 644 - DNA, 20 bp, Artificial Sequence
  Synthetic polynucleotide
aggtgcttcctcaccgatat

SEQ ID NO: 645 - DNA, 20 bp, Artificial Sequence
  Synthetic polynucleotide
tggcacactgtgagctgcct

SEQ ID NO: 646 - DNA, 20 bp, Artificial Sequence
  Synthetic polynucleotide
tgcctggctccacgccctgc

SEQ ID NO: 647 - DNA, 20 bp, Artificial Sequence
  Synthetic polynucleotide
cagcaggctgttgtgtgaca

SEQ ID NO: 648 - DNA, 20 bp, Artificial Sequence
  Synthetic polynucleotide
gctcccgcgcgcgctgctgg

SEQ ID NO: 649 - DNA, 20 bp, Artificial Sequence
  Synthetic polynucleotide
catagaagtggtagaggcac

SEQ ID NO: 650 - DNA, 20 bp, Artificial Sequence
  Synthetic polynucleotide
caggggccatgtgccctcgg

SEQ ID NO: 651 - DNA, 20 bp, Artificial Sequence
  Synthetic polynucleotide
ctctcaccgatcacttcatc

SEQ ID NO: 652 - DNA, 20 bp, Artificial Sequence
  Synthetic polynucleotide
agcttccccaaggatgcctt

SEQ ID NO: 653 - DNA, 20 bp, Artificial Sequence
  Synthetic polynucleotide
gacctctgaaaaggaccggc

SEQ ID NO: 654 - DNA, 20 bp, Artificial Sequence
  Synthetic polynucleotide
tgcccttgattgtccttttc

SEQ ID NO: 655 - DNA, 20 bp, Artificial Sequence
  Synthetic polynucleotide
aggctgtgtgcttctgagct

SEQ ID NO: 656 - DNA, 20 bp, Artificial Sequence
  Synthetic polynucleotide
caggtgggccctcctccctc

SEQ ID NO: 657 - DNA, 20 bp, Artificial Sequence
  Synthetic polynucleotide
agggaggcttatgccaatat

SEQ ID NO: 658 - DNA, 20 bp, Artificial Sequence
  Synthetic polynucleotide
aaaccacctccgagggcaca

SEQ ID NO: 659 - DNA, 20 bp, Artificial Sequence
  Synthetic polynucleotide
aaatttccttcttcatccaa

SEQ ID NO: 660 - DNA, 20 bp, Artificial Sequence
  Synthetic polynucleotide
cagttgatggtgtctgtgtc

SEQ ID NO: 661 - DNA, 20 bp, Artificial Sequence
  Synthetic polynucleotide
ccgggagctgctgcctggct

SEQ ID NO: 662 - DNA, 20 bp, Artificial Sequence
  Synthetic polynucleotide
gaagagattgagctctactc

SEQ ID NO: 663 - DNA, 20 bp, Artificial Sequence
  Synthetic polynucleotide
tggtgtctgtgtcgggttct

SEQ ID NO: 664 - DNA, 20 bp, Artificial Sequence
  Synthetic polynucleotide
aggccaccagcagcgcgcgc

SEQ ID NO: 665 - DNA, 20 bp, Artificial Sequence
  Synthetic polynucleotide
cccacttcggggagagtccc

SEQ ID NO: 666 - DNA, 20 bp, Artificial Sequence
  Synthetic polynucleotide
gaggctgtgtgcttctgagc

SEQ ID NO: 667 - DNA, 20 bp, Artificial Sequence
  Synthetic polynucleotide
cgggctcccgcgcgcgctgc

SEQ ID NO: 668 - DNA, 20 bp, Artificial Sequence
  Synthetic polynucleotide
tttcccggcctttttacctt

SEQ ID NO: 669 - DNA, 20 bp, Artificial Sequence
  Synthetic polynucleotide
agctgaggggtgggggatac

SEQ ID NO: 670 - DNA, 20 bp, Artificial Sequence
  Synthetic polynucleotide
ccggtccttttcagaggtct

SEQ ID NO: 671 - DNA, 20 bp, Artificial Sequence
  Synthetic polynucleotide
aagcaaggctaggttggatc

SEQ ID NO: 672 - DNA, 20 bp, Artificial Sequence
  Synthetic polynucleotide
tgattgtgtgagttggtctc

SEQ ID NO: 673 - DNA, 20 bp, Artificial Sequence
  Synthetic polynucleotide
atggtgtctgtgtcgggttc

SEQ ID NO: 674 - DNA, 20 bp, Artificial Sequence
  Synthetic polynucleotide
aggcagcagctcccggagtc

SEQ ID NO: 675 - DNA, 20 bp, Artificial Sequence
  Synthetic polynucleotide
agccccaaggtaaaaaggcc

SEQ ID NO: 676 - DNA, 20 bp, Artificial Sequence
  Synthetic polynucleotide
tgcttggttgctccacagcc

SEQ ID NO: 677 - DNA, 20 bp, Artificial Sequence
  Synthetic polynucleotide
atctgcaagtcctgagttgc

SEQ ID NO: 678 - DNA, 20 bp, Artificial Sequence
  Synthetic polynucleotide
attgtgtaggaatcccagcc

SEQ ID NO: 679 - DNA, 20 bp, Artificial Sequence
  Synthetic polynucleotide
ggcagggctcttgccacggc

SEQ ID NO: 680 - DNA, 20 bp, Artificial Sequence
  Synthetic polynucleotide
tccgggagctgctgcctggc

SEQ ID NO: 681 - DNA, 20 bp, Artificial Sequence
  Synthetic polynucleotide
ggcatccttggggaagctga

SEQ ID NO: 682 - DNA, 20 bp, Artificial Sequence
  Synthetic polynucleotide
tatgaccagatggacctggc

SEQ ID NO: 683 - DNA, 20 bp, Artificial Sequence
  Synthetic polynucleotide
agggctcttgccacggctgg

SEQ ID NO: 684 - DNA, 20 bp, Artificial Sequence
  Synthetic polynucleotide
caatctcttcttctccagcc

SEQ ID NO: 685 - DNA, 20 bp, Artificial Sequence
  Synthetic polynucleotide
acccagcagggcgtggagcc

SEQ ID NO: 686 - DNA, 20 bp, Artificial Sequence
  Synthetic polynucleotide
cttttctgcccaacttctgc

SEQ ID NO: 687 - DNA, 20 bp, Artificial Sequence
  Synthetic polynucleotide
agctcagttagctcatctca

SEQ ID NO: 688 - DNA, 20 bp, Artificial Sequence
  Synthetic polynucleotide
agggaaaaagaactgcgggg

SEQ ID NO: 689 - DNA, 20 bp, Artificial Sequence
  Synthetic polynucleotide
gagattgagctctactcagg

SEQ ID NO: 690 - DNA, 20 bp, Artificial Sequence
  Synthetic polynucleotide
gagttggggcccctagaagg

SEQ ID NO: 691 - DNA, 20 bp, Artificial Sequence
  Synthetic polynucleotide
tagaagtggtagaggcacag

SEQ ID NO: 692 - DNA, 20 bp, Artificial Sequence
  Synthetic polynucleotide
agaagtggtagaggcacagg

SEQ ID NO: 693 - DNA, 20 bp, Artificial Sequence
  Synthetic polynucleotide
cggaagagaccagagggagg

SEQ ID NO: 694 - DNA, 20 bp, Artificial Sequence
  Synthetic polynucleotide
tcaactgcgaccagttcagc

SEQ ID NO: 695 - DNA, 20 bp, Artificial Sequence
  Synthetic polynucleotide
tgtctgtgtcgggttctggg

SEQ ID NO: 696 - DNA, 20 bp, Artificial Sequence
  Synthetic polynucleotide
gattgtccttttctgggctc

SEQ ID NO: 697 - DNA, 20 bp, Artificial Sequence
  Synthetic polynucleotide
aaaagtcccttggatgaaga

SEQ ID NO: 698 - DNA, 20 bp, Artificial Sequence
  Synthetic polynucleotide
tggaaggtgatgaagagacc

SEQ ID NO: 699 - RNA, 20 nt, Artificial Sequence
  Synthetic polynucleotide
cuggggccgcggcaagucug

SEQ ID NO: 700 - RNA, 20 nt, Artificial Sequence
  Synthetic polynucleotide
cuccagucgguuccucacag

SEQ ID NO: 701 - RNA, 20 nt, Artificial Sequence
  Synthetic polynucleotide
agaggucuuggauuccugcu

SEQ ID NO: 702 - RNA, 20 nt, Artificial Sequence
  Synthetic polynucleotide
gcccugccgguccuuuucag

SEQ ID NO: 703 - RNA, 20 nt, Artificial Sequence
  Synthetic polynucleotide
agacuccgggagcugcugcc

SEQ ID NO: 704 - RNA, 20 nt, Artificial Sequence
  Synthetic polynucleotide
gucaccuaccgcuguucccc

SEQ ID NO: 705 - RNA, 20 nt, Artificial Sequence
  Synthetic polynucleotide
gccuggcuccacgcccugcu

SEQ ID NO: 706 - RNA, 20 nt, Artificial Sequence
  Synthetic polynucleotide
cugggacucuccccgaagug

SEQ ID NO: 707 - RNA, 20 nt, Artificial Sequence
  Synthetic polynucleotide
gagcugccacagacuugccg

SEQ ID NO: 708 - RNA, 20 nt, Artificial Sequence
  Synthetic polynucleotide
cuuggaugccccaggcaguu

SEQ ID NO: 709 - RNA, 20 nt, Artificial Sequence
  Synthetic polynucleotide
ucugcaaguccugaguugca

SEQ ID NO: 710 - RNA, 20 nt, Artificial Sequence
  Synthetic polynucleotide
gggauaccggaagagaccag

SEQ ID NO: 711 - RNA, 20 nt, Artificial Sequence
  Synthetic polynucleotide
ggucaccuaccgcuguuccc

SEQ ID NO: 712 - RNA, 20 nt, Artificial Sequence
  Synthetic polynucleotide
acaaugcucagucaccucac

SEQ ID NO: 713 - RNA, 20 nt, Artificial Sequence
  Synthetic polynucleotide
ggagcccggggaacagcggu

SEQ ID NO: 714 - RNA, 20 nt, Artificial Sequence
  Synthetic polynucleotide
ggccacugugaggaaccgac

SEQ ID NO: 715 - RNA, 20 nt, Artificial Sequence
  Synthetic polynucleotide
uggagaugccagcagaaguu

SEQ ID NO: 716 - RNA, 20 nt, Artificial Sequence
  Synthetic polynucleotide
auaggaccagaugaagugau

SEQ ID NO: 717 - RNA, 20 nt, Artificial Sequence
  Synthetic polynucleotide
cuucugagcugggcauccga

SEQ ID NO: 718 - RNA, 20 nt, Artificial Sequence
  Synthetic polynucleotide
uccuaccugucagagcccca

SEQ ID NO: 719 - RNA, 20 nt, Artificial Sequence
  Synthetic polynucleotide
gcccagaaaaggacaaucaa

SEQ ID NO: 720 - RNA, 20 nt, Artificial Sequence
  Synthetic polynucleotide
gaggugguuugccacuuuca

SEQ ID NO: 721 - RNA, 20 nt, Artificial Sequence
  Synthetic polynucleotide
gaagcugagggcacgaggag

SEQ ID NO: 722 - RNA, 20 nt, Artificial Sequence
  Synthetic polynucleotide
ggcuuaugccaauaucggug

SEQ ID NO: 723 - RNA, 20 nt, Artificial Sequence
  Synthetic polynucleotide
cuccucugaugcuggcccua

SEQ ID NO: 724 - RNA, 20 nt, Artificial Sequence
  Synthetic polynucleotide
ggauaccggaagagaccaga

SEQ ID NO: 725 - RNA, 20 nt, Artificial Sequence
  Synthetic polynucleotide
ggacaagcucccugcaacuc

SEQ ID NO: 726 - RNA, 20 nt, Artificial Sequence
  Synthetic polynucleotide
cauccauggaagguaccuga

SEQ ID NO: 727 - RNA, 20 nt, Artificial Sequence
  Synthetic polynucleotide
uagcucaguuagcucaucuc

SEQ ID NO: 728 - RNA, 20 nt, Artificial Sequence
  Synthetic polynucleotide
gauauuggcauaagccuccc

SEQ ID NO: 729 - RNA, 20 nt, Artificial Sequence
  Synthetic polynucleotide
uagugaugaggcuagugaug

SEQ ID NO: 730 - RNA, 20 nt, Artificial Sequence
  Synthetic polynucleotide
gaaguggcaucccaacugcc

SEQ ID NO: 731 - RNA, 20 nt, Artificial Sequence
  Synthetic polynucleotide
gcucaguuagcucaucucag

SEQ ID NO: 732 - RNA, 20 nt, Artificial Sequence
  Synthetic polynucleotide
aggugaugaagagaccaggg

SEQ ID NO: 733 - RNA, 20 nt, Artificial Sequence
  Synthetic polynucleotide
gaggccaccagcagcgcgcg

SEQ ID NO: 734 - RNA, 20 nt, Artificial Sequence
  Synthetic polynucleotide
uucuaggggccccaacucca

SEQ ID NO: 735 - RNA, 20 nt, Artificial Sequence
  Synthetic polynucleotide
agucuccucuguaaccccua

SEQ ID NO: 736 - RNA, 20 nt, Artificial Sequence
  Synthetic polynucleotide
aaguggcaaaccaccuccga

SEQ ID NO: 737 - RNA, 20 nt, Artificial Sequence
  Synthetic polynucleotide
uuuuaccuuggggcucugac

SEQ ID NO: 738 - RNA, 20 nt, Artificial Sequence
  Synthetic polynucleotide
gguccaucuggucauagaag

SEQ ID NO: 739 - RNA, 20 nt, Artificial Sequence
  Synthetic polynucleotide
gagcaaccaagcaccuacug

SEQ ID NO: 740 - RNA, 20 nt, Artificial Sequence
  Synthetic polynucleotide
ucgugcccucagcuucccca

SEQ ID NO: 741 - RNA, 20 nt, Artificial Sequence
  Synthetic polynucleotide
acuucugauaaagcacgugg

SEQ ID NO: 742 - RNA, 20 nt, Artificial Sequence
  Synthetic polynucleotide
auggaguuggggccccuaga

SEQ ID NO: 743 - RNA, 20 nt, Artificial Sequence
  Synthetic polynucleotide
agcccagaaaaggacaauca

SEQ ID NO: 744 - RNA, 20 nt, Artificial Sequence
  Synthetic polynucleotide
uaggggccccaacuccaugg

SEQ ID NO: 745 - RNA, 20 nt, Artificial Sequence
  Synthetic polynucleotide
guggcacacugugagcugcc

SEQ ID NO: 746 - RNA, 20 nt, Artificial Sequence
  Synthetic polynucleotide
gaagcaccugagcccagaaa

SEQ ID NO: 747 - RNA, 20 nt, Artificial Sequence
  Synthetic polynucleotide
gucagagccccaagguaaaa

SEQ ID NO: 748 - RNA, 20 nt, Artificial Sequence
  Synthetic polynucleotide
gcuccagguagccaccuucu

SEQ ID NO: 749 - RNA, 20 nt, Artificial Sequence
  Synthetic polynucleotide
cuuucacgguuggacugagu

SEQ ID NO: 750 - RNA, 20 nt, Artificial Sequence
  Synthetic polynucleotide
gccacuucugauaaagcacg

SEQ ID NO: 751 - RNA, 20 nt, Artificial Sequence
  Synthetic polynucleotide
aaucccucagguaccuucca

SEQ ID NO: 752 - RNA, 20 nt, Artificial Sequence
  Synthetic polynucleotide
gucuguggcagcucguccgc

SEQ ID NO: 753 - RNA, 20 nt, Artificial Sequence
  Synthetic polynucleotide
acacugugagcugccuggga

SEQ ID NO: 754 - RNA, 20 nt, Artificial Sequence
  Synthetic polynucleotide
aaaguggcaaaccaccuccg

SEQ ID NO: 755 - RNA, 20 nt, Artificial Sequence
  Synthetic polynucleotide
aggcauccuuggggaagcug

SEQ ID NO: 756 - RNA, 20 nt, Artificial Sequence
  Synthetic polynucleotide
acucaguccaaccgugaaag

SEQ ID NO: 757 - RNA, 20 nt, Artificial Sequence
  Synthetic polynucleotide
agggaccucuuggaugcccc

SEQ ID NO: 758 - RNA, 20 nt, Artificial Sequence
  Synthetic polynucleotide
agcaaggcuagguuggauca

SEQ ID NO: 759 - RNA, 20 nt, Artificial Sequence
  Synthetic polynucleotide
gcccuugauuguccuuuucu

SEQ ID NO: 760 - RNA, 20 nt, Artificial Sequence
  Synthetic polynucleotide
ggaaggugaugaagagacca

SEQ ID NO: 761 - RNA, 20 nt, Artificial Sequence
  Synthetic polynucleotide
accacgugcuuuaucagaag

SEQ ID NO: 762 - RNA, 20 nt, Artificial Sequence
  Synthetic polynucleotide
accuuggggcucugacaggu

SEQ ID NO: 763 - RNA, 20 nt, Artificial Sequence
  Synthetic polynucleotide
agguaggacccagcagggcg

SEQ ID NO: 764 - RNA, 20 nt, Artificial Sequence
  Synthetic polynucleotide
gggcauccgaaggcauccuu

SEQ ID NO: 765 - RNA, 20 nt, Artificial Sequence
  Synthetic polynucleotide
caguggccagccccacuucg

SEQ ID NO: 766 - RNA, 20 nt, Artificial Sequence
  Synthetic polynucleotide
cccagccaggcagcagcucc

SEQ ID NO: 767 - RNA, 20 nt, Artificial Sequence
  Synthetic polynucleotide
ggcauccgaaggcauccuug

SEQ ID NO: 768 - RNA, 20 nt, Artificial Sequence
  Synthetic polynucleotide
gccugggacucuccccgaag

SEQ ID NO: 769 - RNA, 20 nt, Artificial Sequence
  Synthetic polynucleotide
cacugugaggaaccgacugg

SEQ ID NO: 770 - RNA, 20 nt, Artificial Sequence
  Synthetic polynucleotide
aaaagaacugcggggaggcg

SEQ ID NO: 771 - RNA, 20 nt, Artificial Sequence
  Synthetic polynucleotide
ugagcauugucuucccuccc

SEQ ID NO: 772 - RNA, 20 nt, Artificial Sequence
  Synthetic polynucleotide
ccucagguaccuuccaugga

SEQ ID NO: 773 - RNA, 20 nt, Artificial Sequence
  Synthetic polynucleotide
cacacugugagcugccuggg

SEQ ID NO: 774 - RNA, 20 nt, Artificial Sequence
  Synthetic polynucleotide
cuucuccagccagguccauc

SEQ ID NO: 775 - RNA, 20 nt, Artificial Sequence
  Synthetic polynucleotide
ggaagagaccagagggagga

SEQ ID NO: 776 - RNA, 20 nt, Artificial Sequence
  Synthetic polynucleotide
agccaggcaacgcauugugu

SEQ ID NO: 777 - RNA, 20 nt, Artificial Sequence
  Synthetic polynucleotide
aaggcuagguuggaucaggg

SEQ ID NO: 778 - RNA, 20 nt, Artificial Sequence
  Synthetic polynucleotide
ccugggacucuccccgaagu

SEQ ID NO: 779 - RNA, 20 nt, Artificial Sequence
  Synthetic polynucleotide
acagugugccaccauggagu

SEQ ID NO: 780 - RNA, 20 nt, Artificial Sequence
  Synthetic polynucleotide
ggcuagguuggaucagggag

SEQ ID NO: 781 - RNA, 20 nt, Artificial Sequence
  Synthetic polynucleotide
cuccaaggcaugagacuuug

SEQ ID NO: 782 - RNA, 20 nt, Artificial Sequence
  Synthetic polynucleotide
gccccuagaagguggcuacc

SEQ ID NO: 783 - RNA, 20 nt, Artificial Sequence
  Synthetic polynucleotide
cugacagguaggacccagca

SEQ ID NO: 784 - RNA, 20 nt, Artificial Sequence
  Synthetic polynucleotide
gcagggcucuugccacggcu

SEQ ID NO: 785 - RNA, 20 nt, Artificial Sequence
  Synthetic polynucleotide
gagccccaagguaaaaaggc

SEQ ID NO: 786 - RNA, 20 nt, Artificial Sequence
  Synthetic polynucleotide
gcuauucacuccucugaugc

SEQ ID NO: 787 - RNA, 20 nt, Artificial Sequence
  Synthetic polynucleotide
caucgcuguuaagaagcucc

SEQ ID NO: 788 - RNA, 20 nt, Artificial Sequence
  Synthetic polynucleotide
ggguguggucaugguaacac

SEQ ID NO: 789 - RNA, 20 nt, Artificial Sequence
  Synthetic polynucleotide
aaguggcaucccaacugccu

SEQ ID NO: 790 - RNA, 20 nt, Artificial Sequence
  Synthetic polynucleotide
gggaagcugagggcacgagg

SEQ ID NO: 791 - RNA, 20 nt, Artificial Sequence
  Synthetic polynucleotide
cuucuaugaccagauggacc

SEQ ID NO: 792 - RNA, 20 nt, Artificial Sequence
  Synthetic polynucleotide
cuccagguagccaccuucua

SEQ ID NO: 793 - RNA, 20 nt, Artificial Sequence
  Synthetic polynucleotide
ggaagcugagggcacgagga

SEQ ID NO: 794 - RNA, 20 nt, Artificial Sequence
  Synthetic polynucleotide
caaugcucagucaccucaca

SEQ ID NO: 795 - RNA, 20 nt, Artificial Sequence
  Synthetic polynucleotide
cuuucccggccuuuuuaccu

SEQ ID NO: 796 - RNA, 20 nt, Artificial Sequence
  Synthetic polynucleotide
gcugaacuggucgcaguuga

SEQ ID NO: 797 - RNA, 20 nt, Artificial Sequence
  Synthetic polynucleotide
uugcagaucacuugcccaag

SEQ ID NO: 798 - RNA, 20 nt, Artificial Sequence
  Synthetic polynucleotide
cuccucccucuggucucuuc

SEQ ID NO: 799 - RNA, 20 nt, Artificial Sequence
  Synthetic polynucleotide
uuccuacacaaugcguugcc

SEQ ID NO: 800 - RNA, 20 nt, Artificial Sequence
  Synthetic polynucleotide
uuggggaagcugagggcacg

SEQ ID NO: 801 - RNA, 20 nt, Artificial Sequence
  Synthetic polynucleotide
uccagguagccaccuucuag

SEQ ID NO: 802 - RNA, 20 nt, Artificial Sequence
  Synthetic polynucleotide
ugaagugaucggugagagua

SEQ ID NO: 803 - RNA, 20 nt, Artificial Sequence
  Synthetic polynucleotide
ccucuuuccaacacccugug

SEQ ID NO: 804 - RNA, 20 nt, Artificial Sequence
  Synthetic polynucleotide
accucugaaaaggaccggca

SEQ ID NO: 805 - RNA, 20 nt, Artificial Sequence
  Synthetic polynucleotide
gugaggaaccgacuggaggc

SEQ ID NO: 806 - RNA, 20 nt, Artificial Sequence
  Synthetic polynucleotide
gggccaugugcccucggagg

SEQ ID NO: 807 - RNA, 20 nt, Artificial Sequence
  Synthetic polynucleotide
aggcuagguuggaucaggga

SEQ ID NO: 808 - RNA, 20 nt, Artificial Sequence
  Synthetic polynucleotide
uucccggccuuuuuaccuug

SEQ ID NO: 809 - RNA, 20 nt, Artificial Sequence
  Synthetic polynucleotide
cagaggucuuggauuccugc

SEQ ID NO: 810 - RNA, 20 nt, Artificial Sequence
  Synthetic polynucleotide
auagaagugguagaggcaca

SEQ ID NO: 811 - RNA, 20 nt, Artificial Sequence
  Synthetic polynucleotide
uucugggaggaaaagucccu

SEQ ID NO: 812 - RNA, 20 nt, Artificial Sequence
  Synthetic polynucleotide
ucugacagguaggacccagc

SEQ ID NO: 813 - RNA, 20 nt, Artificial Sequence
  Synthetic polynucleotide
gcaguugauggugucugugu

SEQ ID NO: 814 - RNA, 20 nt, Artificial Sequence
  Synthetic polynucleotide
ccucacaggguguuggaaag

SEQ ID NO: 815 - RNA, 20 nt, Artificial Sequence
  Synthetic polynucleotide
gaccggcagggcucuugcca

SEQ ID NO: 816 - RNA, 20 nt, Artificial Sequence
  Synthetic polynucleotide
uaccggaagagaccagaggg

SEQ ID NO: 817 - RNA, 20 nt, Artificial Sequence
  Synthetic polynucleotide
ugggcauccgaaggcauccu

SEQ ID NO: 818 - RNA, 20 nt, Artificial Sequence
  Synthetic polynucleotide
gaggaggggcugccagacuc

SEQ ID NO: 819 - RNA, 20 nt, Artificial Sequence
  Synthetic polynucleotide
gaaauuuccuucuucaucca

SEQ ID NO: 820 - RNA, 20 nt, Artificial Sequence
  Synthetic polynucleotide
agauugagcucuacucaggu

SEQ ID NO: 821 - RNA, 20 nt, Artificial Sequence
  Synthetic polynucleotide
cagcucacagugugccacca

SEQ ID NO: 822 - RNA, 20 nt, Artificial Sequence
  Synthetic polynucleotide
cuaccacuucuaugaccaga

SEQ ID NO: 823 - RNA, 20 nt, Artificial Sequence
  Synthetic polynucleotide
caccucaaagucucaugccu

SEQ ID NO: 824 - RNA, 20 nt, Artificial Sequence
  Synthetic polynucleotide
aggcuguugugugacaugga

SEQ ID NO: 825 - RNA, 20 nt, Artificial Sequence
  Synthetic polynucleotide
ucuggucauagaagugguag

SEQ ID NO: 826 - RNA, 20 nt, Artificial Sequence
  Synthetic polynucleotide
agugugccaccauggaguug

SEQ ID NO: 827 - RNA, 20 nt, Artificial Sequence
  Synthetic polynucleotide
cagugugccaccauggaguu

SEQ ID NO: 828 - RNA, 20 nt, Artificial Sequence
  Synthetic polynucleotide
cacacaacagccugcugaac

SEQ ID NO: 829 - RNA, 20 nt, Artificial Sequence
  Synthetic polynucleotide
gacucuccccgaaguggggc

SEQ ID NO: 830 - RNA, 20 nt, Artificial Sequence
  Synthetic polynucleotide
cagggcucuugccacggcug

SEQ ID NO: 831 - RNA, 20 nt, Artificial Sequence
  Synthetic polynucleotide
aggaggggcugccagacucc

SEQ ID NO: 832 - RNA, 20 nt, Artificial Sequence
  Synthetic polynucleotide
ugguuugccacuuucacggu

SEQ ID NO: 833 - RNA, 20 nt, Artificial Sequence
  Synthetic polynucleotide
uuucucaaaguagagcacau

SEQ ID NO: 834 - RNA, 20 nt, Artificial Sequence
  Synthetic polynucleotide
acuugccgcggccccagagc

SEQ ID NO: 835 - RNA, 20 nt, Artificial Sequence
  Synthetic polynucleotide
ucagucaccucacagggugu

SEQ ID NO: 836 - RNA, 20 nt, Artificial Sequence
  Synthetic polynucleotide
aggugcuuccucaccgauau

SEQ ID NO: 837 - RNA, 20 nt, Artificial Sequence
  Synthetic polynucleotide
uggcacacugugagcugccu

SEQ ID NO: 838 - RNA, 20 nt, Artificial Sequence
  Synthetic polynucleotide
ugccuggcuccacgcccugc

SEQ ID NO: 839 - RNA, 20 nt, Artificial Sequence
  Synthetic polynucleotide
cagcaggcuguugugugaca

SEQ ID NO: 840 - RNA, 20 nt, Artificial Sequence
  Synthetic polynucleotide
gcucccgcgcgcgcugcugg

SEQ ID NO: 841 - RNA, 20 nt, Artificial Sequence
  Synthetic polynucleotide
cauagaagugguagaggcac

SEQ ID NO: 842 - RNA, 20 nt, Artificial Sequence
  Synthetic polynucleotide
caggggccaugugcccucgg

SEQ ID NO: 843 - RNA, 20 nt, Artificial Sequence
  Synthetic polynucleotide
cucucaccgaucacuucauc

SEQ ID NO: 844 - RNA, 20 nt, Artificial Sequence
  Synthetic polynucleotide
agcuuccccaaggaugccuu

SEQ ID NO: 845 - RNA, 20 nt, Artificial Sequence
  Synthetic polynucleotide
gaccucugaaaaggaccggc

SEQ ID NO: 846 - RNA, 20 nt, Artificial Sequence
  Synthetic polynucleotide
ugcccuugauuguccuuuuc

SEQ ID NO: 847 - RNA, 20 nt, Artificial Sequence
  Synthetic polynucleotide
aggcugugugcuucugagcu

SEQ ID NO: 848 - RNA, 20 nt, Artificial Sequence
  Synthetic polynucleotide
caggugggcccuccucccuc

SEQ ID NO: 849 - RNA, 20 nt, Artificial Sequence
  Synthetic polynucleotide
agggaggcuuaugccaauau

SEQ ID NO: 850 - RNA, 20 nt, Artificial Sequence
  Synthetic polynucleotide
aaaccaccuccgagggcaca

SEQ ID NO: 851 - RNA, 20 nt, Artificial Sequence
  Synthetic polynucleotide
aaauuuccuucuucauccaa

SEQ ID NO: 852 - RNA, 20 nt, Artificial Sequence
  Synthetic polynucleotide
caguugauggugucuguguc

SEQ ID NO: 853 - RNA, 20 nt, Artificial Sequence
  Synthetic polynucleotide
ccgggagcugcugccuggcu

SEQ ID NO: 854 - RNA, 20 nt, Artificial Sequence
  Synthetic polynucleotide
gaagagauugagcucuacuc

SEQ ID NO: 855 - RNA, 20 nt, Artificial Sequence
  Synthetic polynucleotide
uggugucugugucggguucu

SEQ ID NO: 856 - RNA, 20 nt, Artificial Sequence
  Synthetic polynucleotide
aggccaccagcagcgcgcgc

SEQ ID NO: 857 - RNA, 20 nt, Artificial Sequence
  Synthetic polynucleotide
cccacuucggggagaguccc

SEQ ID NO: 858 - RNA, 20 nt, Artificial Sequence
  Synthetic polynucleotide
gaggcugugugcuucugagc

SEQ ID NO: 859 - RNA, 20 nt, Artificial Sequence
  Synthetic polynucleotide
cgggcucccgcgcgcgcugc

SEQ ID NO: 860 - RNA, 20 nt, Artificial Sequence
  Synthetic polynucleotide
uuucccggccuuuuuaccuu

SEQ ID NO: 861 - RNA, 20 nt, Artificial Sequence
  Synthetic polynucleotide
agcugaggggugggggauac

SEQ ID NO: 862 - RNA, 20 nt, Artificial Sequence
  Synthetic polynucleotide
ccgguccuuuucagaggucu

SEQ ID NO: 863 - RNA, 20 nt, Artificial Sequence
  Synthetic polynucleotide
aagcaaggcuagguuggauc

SEQ ID NO: 864 - RNA, 20 nt, Artificial Sequence
  Synthetic polynucleotide
ugauugugugaguuggucuc

SEQ ID NO: 865 - RNA, 20 nt, Artificial Sequence
  Synthetic polynucleotide
auggugucugugucggguuc

SEQ ID NO: 866 - RNA, 20 nt, Artificial Sequence
  Synthetic polynucleotide
aggcagcagcucccggaguc

SEQ ID NO: 867 - RNA, 20 nt, Artificial Sequence
  Synthetic polynucleotide
agccccaagguaaaaaggcc

SEQ ID NO: 868 - RNA, 20 nt, Artificial Sequence
  Synthetic polynucleotide
ugcuugguugcuccacagcc

SEQ ID NO: 869 - RNA, 20 nt, Artificial Sequence
  Synthetic polynucleotide
aucugcaaguccugaguugc

SEQ ID NO: 870 - RNA, 20 nt, Artificial Sequence
  Synthetic polynucleotide
auuguguaggaaucccagcc

SEQ ID NO: 871 - RNA, 20 nt, Artificial Sequence
  Synthetic polynucleotide
ggcagggcucuugccacggc

SEQ ID NO: 872 - RNA, 20 nt, Artificial Sequence
  Synthetic polynucleotide
uccgggagcugcugccuggc

SEQ ID NO: 873 - RNA, 20 nt, Artificial Sequence
  Synthetic polynucleotide
ggcauccuuggggaagcuga

SEQ ID NO: 874 - RNA, 20 nt, Artificial Sequence
  Synthetic polynucleotide
uaugaccagauggaccuggc

SEQ ID NO: 875 - RNA, 20 nt, Artificial Sequence
  Synthetic polynucleotide
agggcucuugccacggcugg

SEQ ID NO: 876 - RNA, 20 nt, Artificial Sequence
  Synthetic polynucleotide
caaucucuucuucuccagcc

SEQ ID NO: 877 - RNA, 20 nt, Artificial Sequence
  Synthetic polynucleotide
acccagcagggcguggagcc

SEQ ID NO: 878 - RNA, 20 nt, Artificial Sequence
  Synthetic polynucleotide
cuuuucugcccaacuucugc

SEQ ID NO: 879 - RNA, 20 nt, Artificial Sequence
  Synthetic polynucleotide
agcucaguuagcucaucuca

SEQ ID NO: 880 - RNA, 20 nt, Artificial Sequence
  Synthetic polynucleotide
agggaaaaagaacugcgggg

SEQ ID NO: 881 - RNA, 20 nt, Artificial Sequence
  Synthetic polynucleotide
gagauugagcucuacucagg

SEQ ID NO: 882 - RNA, 20 nt, Artificial Sequence
  Synthetic polynucleotide
gaguuggggccccuagaagg

SEQ ID NO: 883 - RNA, 20 nt, Artificial Sequence
  Synthetic polynucleotide
uagaagugguagaggcacag

SEQ ID NO: 884 - RNA, 20 nt, Artificial Sequence
  Synthetic polynucleotide
agaagugguagaggcacagg

SEQ ID NO: 885 - RNA, 20 nt, Artificial Sequence
  Synthetic polynucleotide
cggaagagaccagagggagg

SEQ ID NO: 886 - RNA, 20 nt, Artificial Sequence
  Synthetic polynucleotide
ucaacugcgaccaguucagc

SEQ ID NO: 887 - RNA, 20 nt, Artificial Sequence
  Synthetic polynucleotide
ugucugugucggguucuggg

SEQ ID NO: 888 - RNA, 20 nt, Artificial Sequence
  Synthetic polynucleotide
gauuguccuuuucugggcuc

SEQ ID NO: 889 - RNA, 20 nt, Artificial Sequence
  Synthetic polynucleotide
aaaagucccuuggaugaaga

SEQ ID NO: 890 - RNA, 20 nt, Artificial Sequence
  Synthetic polynucleotide
uggaaggugaugaagagacc

SEQ ID NO: 891 - DNA, 20 bp, Artificial Sequence
  Synthetic polynucleotide
tgtctggggagtctgagaga

SEQ ID NO: 892 - DNA, 23 bp, Artificial Sequence
  Synthetic polynucleotide
actgctcaggcggaggtgagcgg

SEQ ID NO: 893 - DNA, 20 bp, Artificial Sequence
  Synthetic polynucleotide
cgcagatcaaagagagcctg

SEQ ID NO: 894 - DNA, 20 bp, Artificial Sequence
  Synthetic polynucleotide
ctgcagcttctccaacacat

SEQ ID NO: 895 - DNA, 23 bp, Artificial Sequence
  Synthetic polynucleotide
gccctggccagtcgtctgggcgg

SEQ ID NO: 896 - DNA, 20 bp, Artificial Sequence
  Synthetic polynucleotide
cagcggcacctacctctgtg

SEQ ID NO: 897 - DNA, 23 bp, Artificial Sequence
  Synthetic polynucleotide
cttctccactgctcaggcggagg

SEQ ID NO: 898 - DNA, 20 bp, Artificial Sequence
  Synthetic polynucleotide
gttggagaagctgcaggtga

SEQ ID NO: 899 - DNA, 20 bp, Artificial Sequence
  Synthetic polynucleotide
cgtgtcacacaactgcccaa

SEQ ID NO: 900 - DNA, 23 bp, Artificial Sequence
  Synthetic polynucleotide
cagtggagaaggcggcactctgg

SEQ ID NO: 901 - DNA, 23 bp, Artificial Sequence
  Synthetic polynucleotide
cgcctgagcagtggagaaggcgg

SEQ ID NO: 902 - DNA, 20 bp, Artificial Sequence
  Synthetic polynucleotide
cccttcggtcaccacgagca

SEQ ID NO: 903 - DNA, 23 bp, Artificial Sequence
  Synthetic polynucleotide
ggcgccctggccagtcgtctggg

SEQ ID NO: 904 - DNA, 23 bp, Artificial Sequence
  Synthetic polynucleotide
gtctgggcggtgctacaactggg

SEQ ID NO: 905 - DNA, 23 bp, Artificial Sequence
  Synthetic polynucleotide
ggagaaggcggcactctggtggg

SEQ ID NO: 906 - DNA, 23 bp, Artificial Sequence
  Synthetic polynucleotide
tgccgccttctccactgctcagg

SEQ ID NO: 907 - DNA, 20 bp, Artificial Sequence
  Synthetic polynucleotide
ggagtctgagagatggagag

SEQ ID NO: 908 - DNA, 20 bp, Artificial Sequence
  Synthetic polynucleotide
gcccacgacaccaaccacca

SEQ ID NO: 909 - DNA, 20 bp, Artificial Sequence
  Synthetic polynucleotide
ccagggagatggccccacag

SEQ ID NO: 910 - DNA, 23 bp, Artificial Sequence
  Synthetic polynucleotide
gctcacctccgcctgagcagtgg

SEQ ID NO: 911 - DNA, 20 bp, Artificial Sequence
  Synthetic polynucleotide
gcagatcaaagagagcctgc

SEQ ID NO: 912 - DNA, 20 bp, Artificial Sequence
  Synthetic polynucleotide
ggagaagctgcaggtgaagg

SEQ ID NO: 913 - DNA, 20 bp, Artificial Sequence
  Synthetic polynucleotide
catgagccccagcaaccaga

SEQ ID NO: 914 - DNA, 20 bp, Artificial Sequence
  Synthetic polynucleotide
tggaagggcacaaaggtcag

SEQ ID NO: 915 - DNA, 20 bp, Artificial Sequence
  Synthetic polynucleotide
gagcctgcgggcagagctca

SEQ ID NO: 916 - DNA, 20 bp, Artificial Sequence
  Synthetic polynucleotide
cgcccacgacaccaaccacc

SEQ ID NO: 917 - DNA, 23 bp, Artificial Sequence
  Synthetic polynucleotide
tggagaaggcggcactctggtgg

SEQ ID NO: 918 - DNA, 23 bp, Artificial Sequence
  Synthetic polynucleotide
tccaggcatgcagatcccacagg

SEQ ID NO: 919 - DNA, 20 bp, Artificial Sequence
  Synthetic polynucleotide
gacagcggcacctacctctg

SEQ ID NO: 920 - DNA, 23 bp, Artificial Sequence
  Synthetic polynucleotide
gagaaggcggcactctggtgggg

SEQ ID NO: 921 - DNA, 20 bp, Artificial Sequence
  Synthetic polynucleotide
gcttgtccgtctggttgctg

SEQ ID NO: 922 - DNA, 20 bp, Artificial Sequence
  Synthetic polynucleotide
cctctgtggggccatctccc

SEQ ID NO: 923 - DNA, 23 bp, Artificial Sequence
  Synthetic polynucleotide
tgcagatcccacaggcgccctgg

SEQ ID NO: 924 - DNA, 23 bp, Artificial Sequence
  Synthetic polynucleotide
cactctggtggggctgctccagg

SEQ ID NO: 925 - DNA, 20 bp, Artificial Sequence
  Synthetic polynucleotide
gcagttgtgtgacacggaag

SEQ ID NO: 926 - DNA, 23 bp, Artificial Sequence
  Synthetic polynucleotide
tgtagcaccgcccagacgactgg

SEQ ID NO: 927 - DNA, 20 bp, Artificial Sequence
  Synthetic polynucleotide
ggccatctccctggccccca

SEQ ID NO: 928 - DNA, 20 bp, Artificial Sequence
  Synthetic polynucleotide
cctgctcgtggtgaccgaag

SEQ ID NO: 929 - DNA, 20 bp, Artificial Sequence
  Synthetic polynucleotide
ggggttccagggcctgtctg

SEQ ID NO: 930 - DNA, 23 bp, Artificial Sequence
  Synthetic polynucleotide
ggccaggatggttcttaggtagg

SEQ ID NO: 931 - DNA, 23 bp, Artificial Sequence
  Synthetic polynucleotide
tcaggcggaggtgagcggaaggg

SEQ ID NO: 932 - DNA, 20 bp, Artificial Sequence
  Synthetic polynucleotide
tctggttgctggggctcatg

SEQ ID NO: 933 - DNA, 20 bp, Artificial Sequence
  Synthetic polynucleotide
cttctccccagccctgctcg

SEQ ID NO: 934 - DNA, 23 bp, Artificial Sequence
  Synthetic polynucleotide
cgactggccagggcgcctgtggg

SEQ ID NO: 935 - DNA, 20 bp, Artificial Sequence
  Synthetic polynucleotide
ttctctctggaagggcacaa

SEQ ID NO: 936 - DNA, 20 bp, Artificial Sequence
  Synthetic polynucleotide
cctggccgtcatctgctccc

SEQ ID NO: 937 - DNA, 23 bp, Artificial Sequence
  Synthetic polynucleotide
ctccgcctgagcagtggagaagg

SEQ ID NO: 938 - DNA, 20 bp, Artificial Sequence
  Synthetic polynucleotide
cgttgggcagttgtgtgaca

SEQ ID NO: 939 - DNA, 23 bp, Artificial Sequence
  Synthetic polynucleotide
ggatggttcttaggtaggtgggg

SEQ ID NO: 940 - DNA, 23 bp, Artificial Sequence
  Synthetic polynucleotide
ggttcttaggtaggtggggtcgg

SEQ ID NO: 941 - DNA, 20 bp, Artificial Sequence
  Synthetic polynucleotide
cggtcaccacgagcagggct

SEQ ID NO: 942 - DNA, 23 bp, Artificial Sequence
  Synthetic polynucleotide
gcctgtgggatctgcatgcctgg

SEQ ID NO: 943 - DNA, 23 bp, Artificial Sequence
  Synthetic polynucleotide
cacctacctaagaaccatcctgg

SEQ ID NO: 944 - DNA, 23 bp, Artificial Sequence
  Synthetic polynucleotide
aggcgccctggccagtcgtctgg

SEQ ID NO: 945 - DNA, 20 bp, Artificial Sequence
  Synthetic polynucleotide
gcgtgacttccacatgagcg

SEQ ID NO: 946 - DNA, 23 bp, Artificial Sequence
  Synthetic polynucleotide
acgactggccagggcgcctgtgg

SEQ ID NO: 947 - DNA, 20 bp, Artificial Sequence
  Synthetic polynucleotide
agggcccggcgcaatgacag

SEQ ID NO: 948 - DNA, 23 bp, Artificial Sequence
  Synthetic polynucleotide
tggcggccaggatggttcttagg

SEQ ID NO: 949 - DNA, 20 bp, Artificial Sequence
  Synthetic polynucleotide
ggtgacaggtgcggcctcgg

SEQ ID NO: 950 - DNA, 20 bp, Artificial Sequence
  Synthetic polynucleotide
gccctgctcgtggtgaccga

SEQ ID NO: 951 - DNA, 20 bp, Artificial Sequence
  Synthetic polynucleotide
cagttccaaaccctggtggt

SEQ ID NO: 952 - DNA, 20 bp, Artificial Sequence
  Synthetic polynucleotide
cgatgtgttggagaagctgc

SEQ ID NO: 953 - DNA, 20 bp, Artificial Sequence
  Synthetic polynucleotide
gtgtcacacaactgcccaac

SEQ ID NO: 954 - DNA, 23 bp, Artificial Sequence
  Synthetic polynucleotide
caggatggttcttaggtaggtgg

SEQ ID NO: 955 - DNA, 20 bp, Artificial Sequence
  Synthetic polynucleotide
ccgggctggctgcggtcctc

SEQ ID NO: 956 - DNA, 20 bp, Artificial Sequence
  Synthetic polynucleotide
gctgcggtcctcggggaagg

SEQ ID NO: 957 - DNA, 20 bp, Artificial Sequence
  Synthetic polynucleotide
cgggctggctgcggtcctcg

SEQ ID NO: 958 - DNA, 23 bp, Artificial Sequence
  Synthetic polynucleotide
cgccttctccactgctcaggcgg

SEQ ID NO: 959 - DNA, 20 bp, Artificial Sequence
  Synthetic polynucleotide
acagcggcacctacctctgt

SEQ ID NO: 960 - DNA, 20 bp, Artificial Sequence
  Synthetic polynucleotide
caagctggccgccttccccg

SEQ ID NO: 961 - DNA, 20 bp, Artificial Sequence
  Synthetic polynucleotide
ctcagctcacccctgccccg

SEQ ID NO: 962 - DNA, 20 bp, Artificial Sequence
  Synthetic polynucleotide
atgtggaagtcacgcccgtt

SEQ ID NO: 963 - DNA, 20 bp, Artificial Sequence
  Synthetic polynucleotide
gagatggagagaggtgagga

SEQ ID NO: 964 - DNA, 20 bp, Artificial Sequence
  Synthetic polynucleotide
gaaggtggcgttgtcccctt

SEQ ID NO: 965 - DNA, 20 bp, Artificial Sequence
  Synthetic polynucleotide
tgacacggaagcggcagtcc

SEQ ID NO: 966 - DNA, 20 bp, Artificial Sequence
  Synthetic polynucleotide
accctggtggttggtgtcgt

SEQ ID NO: 967 - DNA, 20 bp, Artificial Sequence
  Synthetic polynucleotide
cttccacatgagcgtggtca

SEQ ID NO: 968 - DNA, 20 bp, Artificial Sequence
  Synthetic polynucleotide
ccctgctcgtggtgaccgaa

SEQ ID NO: 969 - DNA, 20 bp, Artificial Sequence
  Synthetic polynucleotide
agatggagagaggtgaggaa

SEQ ID NO: 970 - DNA, 20 bp, Artificial Sequence
  Synthetic polynucleotide
tcctggccgtcatctgctcc

SEQ ID NO: 971 - DNA, 20 bp, Artificial Sequence
  Synthetic polynucleotide
ggacccagactagcagcacc

SEQ ID NO: 972 - DNA, 20 bp, Artificial Sequence
  Synthetic polynucleotide
tgacgttacctcgtgcggcc

SEQ ID NO: 973 - DNA, 20 bp, Artificial Sequence
  Synthetic polynucleotide
ctgagagatggagagaggtg

SEQ ID NO: 974 - DNA, 20 bp, Artificial Sequence
  Synthetic polynucleotide
gatggagagaggtgaggaag

SEQ ID NO: 975 - DNA, 20 bp, Artificial Sequence
  Synthetic polynucleotide
caccagggtttggaactggc

SEQ ID NO: 976 - DNA, 20 bp, Artificial Sequence
  Synthetic polynucleotide
gcagggctggggagaaggtg

SEQ ID NO: 977 - DNA, 20 bp, Artificial Sequence
  Synthetic polynucleotide
ggctcagctcacccctgccc

SEQ ID NO: 978 - DNA, 23 bp, Artificial Sequence
  Synthetic polynucleotide
aactgggctggcggccaggatgg

SEQ ID NO: 979 - DNA, 20 bp, Artificial Sequence
  Synthetic polynucleotide
agcagggctggggagaaggt

SEQ ID NO: 980 - DNA, 20 bp, Artificial Sequence
  Synthetic polynucleotide
acatgagcgtggtcagggcc

SEQ ID NO: 981 - DNA, 20 bp, Artificial Sequence
  Synthetic polynucleotide
tcggtcaccacgagcagggc

SEQ ID NO: 982 - DNA, 20 bp, Artificial Sequence
  Synthetic polynucleotide
gggccctgaccacgctcatg

SEQ ID NO: 983 - DNA, 23 bp, Artificial Sequence
  Synthetic polynucleotide
cgtctgggcggtgctacaactgg

SEQ ID NO: 984 - DNA, 20 bp, Artificial Sequence
  Synthetic polynucleotide
ctggctgcggtcctcgggga

SEQ ID NO: 985 - DNA, 20 bp, Artificial Sequence
  Synthetic polynucleotide
tttgtgcccttccagagaga

SEQ ID NO: 986 - DNA, 23 bp, Artificial Sequence
  Synthetic polynucleotide
aggatggttcttaggtaggtggg

SEQ ID NO: 987 - DNA, 20 bp, Artificial Sequence
  Synthetic polynucleotide
ggtgctgctagtctgggtcc

SEQ ID NO: 988 - DNA, 20 bp, Artificial Sequence
  Synthetic polynucleotide
ggcacttctgcccttctctc

SEQ ID NO: 989 - DNA, 20 bp, Artificial Sequence
  Synthetic polynucleotide
acaaaggtcaggggttagga

SEQ ID NO: 990 - DNA, 20 bp, Artificial Sequence
  Synthetic polynucleotide
ttctgcccttctctctggaa

SEQ ID NO: 991 - DNA, 20 bp, Artificial Sequence
  Synthetic polynucleotide
catgtggaagtcacgcccgt

SEQ ID NO: 992 - DNA, 20 bp, Artificial Sequence
  Synthetic polynucleotide
gtgcggcctcggaggccccg

SEQ ID NO: 993 - DNA, 20 bp, Artificial Sequence
  Synthetic polynucleotide
gatctgcgccttgggggcca

SEQ ID NO: 994 - DNA, 23 bp, Artificial Sequence
  Synthetic polynucleotide
gggcggtgctacaactgggctgg

SEQ ID NO: 995 - DNA, 20 bp, Artificial Sequence
  Synthetic polynucleotide
gaggtgaggaaggggctggg

SEQ ID NO: 996 - DNA, 20 bp, Artificial Sequence
  Synthetic polynucleotide
acggaagcggcagtcctggc

SEQ ID NO: 997 - DNA, 20 bp, Artificial Sequence
  Synthetic polynucleotide
ctggaagggcacaaaggtca

SEQ ID NO: 998 - DNA, 20 bp, Artificial Sequence
  Synthetic polynucleotide
gaggggctggggtgggctgt

SEQ ID NO: 999 - DNA, 20 bp, Artificial Sequence
  Synthetic polynucleotide
acttccacatgagcgtggtc

SEQ ID NO: 1000 - DNA, 20 bp, Artificial Sequence
  Synthetic polynucleotide
ggtcaccacgagcagggctg

SEQ ID NO: 1001 - DNA, 20 bp, Artificial Sequence
  Synthetic polynucleotide
cgccttgggggccagggaga

SEQ ID NO: 1002 - DNA, 20 bp, Artificial Sequence
  Synthetic polynucleotide
agccggccagttccaaaccc

SEQ ID NO: 1003 - DNA, 20 bp, Artificial Sequence
  Synthetic polynucleotide
tgcggcccgggagcagatga

SEQ ID NO: 1004 - DNA, 20 bp, Artificial Sequence
  Synthetic polynucleotide
cccgaggaccgcagccagcc

SEQ ID NO: 1005 - DNA, 20 bp, Artificial Sequence
  Synthetic polynucleotide
gtaacgtcatcccagcccct

SEQ ID NO: 1006 - DNA, 20 bp, Artificial Sequence
  Synthetic polynucleotide
ggtgtcgtgggcggcctgct

SEQ ID NO: 1007 - DNA, 20 bp, Artificial Sequence
  Synthetic polynucleotide
atctctcagactccccagac

SEQ ID NO: 1008 - DNA, 23 bp, Artificial Sequence
  Synthetic polynucleotide
ggtaggtggggtcggcggtcagg

SEQ ID NO: 1009 - DNA, 20 bp, Artificial Sequence
  Synthetic polynucleotide
aggtgccgctgtcattgcgc

SEQ ID NO: 1010 - DNA, 20 bp, Artificial Sequence
  Synthetic polynucleotide
tgggatgacgttacctcgtg

SEQ ID NO: 1011 - DNA, 20 bp, Artificial Sequence
  Synthetic polynucleotide
tcaccctgagctctgcccgc

SEQ ID NO: 1012 - DNA, 20 bp, Artificial Sequence
  Synthetic polynucleotide
cggccagttccaaaccctgg

SEQ ID NO: 1013 - DNA, 20 bp, Artificial Sequence
  Synthetic polynucleotide
gctcagctcacccctgcccc

SEQ ID NO: 1014 - DNA, 20 bp, Artificial Sequence
  Synthetic polynucleotide
cgggcagagctcagggtgac

SEQ ID NO: 1015 - DNA, 20 bp, Artificial Sequence
  Synthetic polynucleotide
ggtgccgctgtcattgcgcc

SEQ ID NO: 1016 - DNA, 20 bp, Artificial Sequence
  Synthetic polynucleotide
gcagcctggtgctgctagtc

SEQ ID NO: 1017 - DNA, 20 bp, Artificial Sequence
  Synthetic polynucleotide
tggaactggccggctggcct

SEQ ID NO: 1018 - DNA, 20 bp, Artificial Sequence
  Synthetic polynucleotide
gagcagggctggggagaagg

SEQ ID NO: 1019 - DNA, 20 bp, Artificial Sequence
  Synthetic polynucleotide
cacgagcagggctggggaga

SEQ ID NO: 1020 - DNA, 20 bp, Artificial Sequence
  Synthetic polynucleotide
ggaccgcagccagcccggcc

SEQ ID NO: 1021 - DNA, 20 bp, Artificial Sequence
  Synthetic polynucleotide
cagggctggggagaaggtgg

SEQ ID NO: 1022 - DNA, 20 bp, Artificial Sequence
  Synthetic polynucleotide
ccccttcggtcaccacgagc

SEQ ID NO: 1023 - DNA, 20 bp, Artificial Sequence
  Synthetic polynucleotide
atctgctcccgggccgcacg

SEQ ID NO: 1024 - DNA, 20 bp, Artificial Sequence
  Synthetic polynucleotide
cttctgcccttctctctgga

SEQ ID NO: 1025 - DNA, 20 bp, Artificial Sequence
  Synthetic polynucleotide
agcttgtccgtctggttgct

SEQ ID NO: 1026 - DNA, 20 bp, Artificial Sequence
  Synthetic polynucleotide
cctcggaggccccggggcag

SEQ ID NO: 1027 - DNA, 20 bp, Artificial Sequence
  Synthetic polynucleotide
aggcggccagcttgtccgtc

SEQ ID NO: 1028 - DNA, 20 bp, Artificial Sequence
  Synthetic polynucleotide
agggtttggaactggccggc

SEQ ID NO: 1029 - DNA, 20 bp, Artificial Sequence
  Synthetic polynucleotide
agagcctgcgggcagagctc

SEQ ID NO: 1030 - DNA, 20 bp, Artificial Sequence
  Synthetic polynucleotide
caaccaccagggtttggaac

SEQ ID NO: 1031 - DNA, 20 bp, Artificial Sequence
  Synthetic polynucleotide
tctggaagggcacaaaggtc

SEQ ID NO: 1032 - DNA, 20 bp, Artificial Sequence
  Synthetic polynucleotide
ggcctcggaggccccggggc

SEQ ID NO: 1033 - DNA, 20 bp, Artificial Sequence
  Synthetic polynucleotide
agagctcagggtgacaggtg

SEQ ID NO: 1034 - DNA, 23 bp, Artificial Sequence
  Synthetic polynucleotide
cggtgctacaactgggctggcgg

SEQ ID NO: 1035 - DNA, 20 bp, Artificial Sequence
  Synthetic polynucleotide
cagcctggtgctgctagtct

SEQ ID NO: 1036 - DNA, 20 bp, Artificial Sequence
  Synthetic polynucleotide
ggagatggccccacagaggt

SEQ ID NO: 1037 - DNA, 20 bp, Artificial Sequence
  Synthetic polynucleotide
aaaggtcaggggttaggacg

SEQ ID NO: 1038 - DNA, 20 bp, Artificial Sequence
  Synthetic polynucleotide
caaaggtcaggggttaggac

SEQ ID NO: 1039 - DNA, 20 bp, Artificial Sequence
  Synthetic polynucleotide
ctggtggttggtgtcgtggg

SEQ ID NO: 1040 - DNA, 20 bp, Artificial Sequence
  Synthetic polynucleotide
cccgggagcagatgacggcc

SEQ ID NO: 1041 - DNA, 20 bp, Artificial Sequence
  Synthetic polynucleotide
cggagagcttcgtgctaaac

SEQ ID NO: 1042 - DNA, 20 bp, Artificial Sequence
  Synthetic polynucleotide
cacgaagctctccgatgtgt

SEQ ID NO: 1043 - DNA, 20 bp, Artificial Sequence
  Synthetic polynucleotide
cccctgccccggggcctccg

SEQ ID NO: 1044 - DNA, 20 bp, Artificial Sequence
  Synthetic polynucleotide
gggctggggagaaggtgggg

SEQ ID NO: 1045 - DNA, 20 bp, Artificial Sequence
  Synthetic polynucleotide
gagagaggtgaggaaggggc

SEQ ID NO: 1046 - DNA, 20 bp, Artificial Sequence
  Synthetic polynucleotide
ggggggttccagggcctgtc

SEQ ID NO: 1047 - DNA, 20 bp, Artificial Sequence
  Synthetic polynucleotide
tggtgtcgtgggcggcctgc

SEQ ID NO: 1048 - DNA, 20 bp, Artificial Sequence
  Synthetic polynucleotide
agggctggggagaaggtggg

SEQ ID NO: 1049 - DNA, 20 bp, Artificial Sequence
  Synthetic polynucleotide
ggtgcggcctcggaggcccc

SEQ ID NO: 1050 - DNA, 20 bp, Artificial Sequence
  Synthetic polynucleotide
agcccctcacccaggccagc

SEQ ID NO: 1051 - DNA, 23 bp, Artificial Sequence
  Synthetic polynucleotide
ctcaggcggaggtgagcggaagg

SEQ ID NO: 1052 - DNA, 20 bp, Artificial Sequence
  Synthetic polynucleotide
agcggcagtcctggccgggc

SEQ ID NO: 1053 - DNA, 20 bp, Artificial Sequence
  Synthetic polynucleotide
gggcacaaaggtcaggggtt

SEQ ID NO: 1054 - DNA, 20 bp, Artificial Sequence
  Synthetic polynucleotide
cagcttgtccgtctggttgc

SEQ ID NO: 1055 - DNA, 20 bp, Artificial Sequence
  Synthetic polynucleotide
cctgggtgaggggctggggt

SEQ ID NO: 1056 - DNA, 20 bp, Artificial Sequence
  Synthetic polynucleotide
cgacaccaaccaccagggtt

SEQ ID NO: 1057 - DNA, 20 bp, Artificial Sequence
  Synthetic polynucleotide
cggaagcggcagtcctggcc

SEQ ID NO: 1058 - DNA, 20 bp, Artificial Sequence
  Synthetic polynucleotide
ttggaactggccggctggcc

SEQ ID NO: 1059 - DNA, 20 bp, Artificial Sequence
  Synthetic polynucleotide
ggagaaggtgggggggttcc

SEQ ID NO: 1060 - DNA, 23 bp, Artificial Sequence
  Synthetic polynucleotide
accgcccagacgactggccaggg

SEQ ID NO: 1061 - DNA, 20 bp, Artificial Sequence
  Synthetic polynucleotide
gagaaggtgggggggttcca

SEQ ID NO: 1062 - DNA, 20 bp, Artificial Sequence
  Synthetic polynucleotide
ctggccggctggcctgggtg

SEQ ID NO: 1063 - DNA, 23 bp, Artificial Sequence
  Synthetic polynucleotide
ctacaactgggctggcggccagg

SEQ ID NO: 1064 - DNA, 23 bp, Artificial Sequence
  Synthetic polynucleotide
tcttaggtaggtggggtcggcgg

SEQ ID NO: 1065 - DNA, 20 bp, Artificial Sequence
  Synthetic polynucleotide
gggggttccagggcctgtct

SEQ ID NO: 1066 - DNA, 23 bp, Artificial Sequence
  Synthetic polynucleotide
caccgcccagacgactggccagg

SEQ ID NO: 1067 - DNA, 20 bp, Artificial Sequence
  Synthetic polynucleotide
ctctttgatctgcgccttgg

SEQ ID NO: 1068 - DNA, 20 bp, Artificial Sequence
  Synthetic polynucleotide
gccgggctggctgcggtcct

SEQ ID NO: 1069 - DNA, 20 bp, Artificial Sequence
  Synthetic polynucleotide
aggtgcggcctcggaggccc

SEQ ID NO: 1070 - DNA, 20 bp, Artificial Sequence
  Synthetic polynucleotide
tgatctgcgccttgggggcc

SEQ ID NO: 1071 - DNA, 20 bp, Artificial Sequence
  Synthetic polynucleotide
cagactccccagacaggccc

SEQ ID NO: 1072 - DNA, 20 bp, Artificial Sequence
  Synthetic polynucleotide
cagcaaccagacggacaagc

SEQ ID NO: 1073 - DNA, 20 bp, Artificial Sequence
  Synthetic polynucleotide
tctctttgatctgcgccttg

SEQ ID NO: 1074 - DNA, 20 bp, Artificial Sequence
  Synthetic polynucleotide
ttgtgcccttccagagagaa

SEQ ID NO: 1075 - DNA, 20 bp, Artificial Sequence
  Synthetic polynucleotide
agtcctggccgggctggctg

SEQ ID NO: 1076 - DNA, 20 bp, Artificial Sequence
  Synthetic polynucleotide
agagaggtgaggaaggggct

SEQ ID NO: 1077 - DNA, 20 bp, Artificial Sequence
  Synthetic polynucleotide
gctctctttgatctgcgcct

SEQ ID NO: 1078 - DNA, 20 bp, Artificial Sequence
  Synthetic polynucleotide
cagggtgacaggtgcggcct

SEQ ID NO: 1079 - DNA, 20 bp, Artificial Sequence
  Synthetic polynucleotide
gcctcggaggccccggggca

SEQ ID NO: 1080 - DNA, 20 bp, Artificial Sequence
  Synthetic polynucleotide
ctctctttgatctgcgcctt

SEQ ID NO: 1081 - DNA, 20 bp, Artificial Sequence
  Synthetic polynucleotide
gacgttacctcgtgcggccc

SEQ ID NO: 1082 - DNA, 20 bp, Artificial Sequence
  Synthetic polynucleotide
aaccctggtggttggtgtcg

SEQ ID NO: 1083 - RNA, 20 nt, Artificial Sequence
  Synthetic polynucleotide
ugucuggggagucugagaga

SEQ ID NO: 1084 - RNA, 20 nt, Artificial Sequence
  Synthetic polynucleotide
acugcucaggcggaggugag

SEQ ID NO: 1085 - RNA, 20 nt, Artificial Sequence
  Synthetic polynucleotide
cgcagaucaaagagagccug

SEQ ID NO: 1086 - RNA, 20 nt, Artificial Sequence
  Synthetic polynucleotide
cugcagcuucuccaacacau

SEQ ID NO: 1087 - RNA, 20 nt, Artificial Sequence
  Synthetic polynucleotide
cgccuucuccacugcucagg

SEQ ID NO: 1088 - RNA, 20 nt, Artificial Sequence
  Synthetic polynucleotide
cagcggcaccuaccucugug

SEQ ID NO: 1089 - RNA, 20 nt, Artificial Sequence
  Synthetic polynucleotide
acgacuggccagggcgccug

SEQ ID NO: 1090 - RNA, 20 nt, Artificial Sequence
  Synthetic polynucleotide
guuggagaagcugcagguga

SEQ ID NO: 1091 - RNA, 20 nt, Artificial Sequence
  Synthetic polynucleotide
cgugucacacaacugcccaa

SEQ ID NO: 1092 - RNA, 20 nt, Artificial Sequence
  Synthetic polynucleotide
ggagaaggcggcacucuggu

SEQ ID NO: 1093 - RNA, 20 nt, Artificial Sequence
  Synthetic polynucleotide
gcucaccuccgccugagcag

SEQ ID NO: 1094 - RNA, 20 nt, Artificial Sequence
  Synthetic polynucleotide
cccuucggucaccacgagca

SEQ ID NO: 1095 - RNA, 20 nt, Artificial Sequence
  Synthetic polynucleotide
ucuuagguagguggggucgg

SEQ ID NO: 1096 - RNA, 20 nt, Artificial Sequence
  Synthetic polynucleotide
cgacuggccagggcgccugu

SEQ ID NO: 1097 - RNA, 20 nt, Artificial Sequence
  Synthetic polynucleotide
cggugcuacaacugggcugg

SEQ ID NO: 1098 - RNA, 20 nt, Artificial Sequence
  Synthetic polynucleotide
cucaggcggaggugagcgga

SEQ ID NO: 1099 - RNA, 20 nt, Artificial Sequence
  Synthetic polynucleotide
ggagucugagagauggagag

SEQ ID NO: 1100 - RNA, 20 nt, Artificial Sequence
  Synthetic polynucleotide
gcccacgacaccaaccacca

SEQ ID NO: 1101 - RNA, 20 nt, Artificial Sequence
  Synthetic polynucleotide
ccagggagauggccccacag

SEQ ID NO: 1102 - RNA, 20 nt, Artificial Sequence
  Synthetic polynucleotide
aggcgcccuggccagucguc

SEQ ID NO: 1103 - RNA, 20 nt, Artificial Sequence
  Synthetic polynucleotide
gcagaucaaagagagccugc

SEQ ID NO: 1104 - RNA, 20 nt, Artificial Sequence
  Synthetic polynucleotide
ggagaagcugcaggugaagg

SEQ ID NO: 1105 - RNA, 20 nt, Artificial Sequence
  Synthetic polynucleotide
caugagccccagcaaccaga

SEQ ID NO: 1106 - RNA, 20 nt, Artificial Sequence
  Synthetic polynucleotide
uggaagggcacaaaggucag

SEQ ID NO: 1107 - RNA, 20 nt, Artificial Sequence
  Synthetic polynucleotide
gagccugcgggcagagcuca

SEQ ID NO: 1108 - RNA, 20 nt, Artificial Sequence
  Synthetic polynucleotide
cgcccacgacaccaaccacc

SEQ ID NO: 1109 - RNA, 20 nt, Artificial Sequence
  Synthetic polynucleotide
gagaaggcggcacucuggug

SEQ ID NO: 1110 - RNA, 20 nt, Artificial Sequence
  Synthetic polynucleotide
caguggagaaggcggcacuc

SEQ ID NO: 1111 - RNA, 20 nt, Artificial Sequence
  Synthetic polynucleotide
gacagcggcaccuaccucug

SEQ ID NO: 1112 - RNA, 20 nt, Artificial Sequence
  Synthetic polynucleotide
gggcggugcuacaacugggc

SEQ ID NO: 1113 - RNA, 20 nt, Artificial Sequence
  Synthetic polynucleotide
gcuuguccgucugguugcug

SEQ ID NO: 1114 - RNA, 20 nt, Artificial Sequence
  Synthetic polynucleotide
ccucuguggggccaucuccc

SEQ ID NO: 1115 - RNA, 20 nt, Artificial Sequence
  Synthetic polynucleotide
cuucuccacugcucaggcgg

SEQ ID NO: 1116 - RNA, 20 nt, Artificial Sequence
  Synthetic polynucleotide
uggagaaggcggcacucugg

SEQ ID NO: 1117 - RNA, 20 nt, Artificial Sequence
  Synthetic polynucleotide
gcaguugugugacacggaag

SEQ ID NO: 1118 - RNA, 20 nt, Artificial Sequence
  Synthetic polynucleotide
uguagcaccgcccagacgac

SEQ ID NO: 1119 - RNA, 20 nt, Artificial Sequence
  Synthetic polynucleotide
ggccaucucccuggccccca

SEQ ID NO: 1120 - RNA, 20 nt, Artificial Sequence
  Synthetic polynucleotide
ccugcucguggugaccgaag

SEQ ID NO: 1121 - RNA, 20 nt, Artificial Sequence
  Synthetic polynucleotide
gggguuccagggccugucug

SEQ ID NO: 1122 - RNA, 20 nt, Artificial Sequence
  Synthetic polynucleotide
cgucugggcggugcuacaac

SEQ ID NO: 1123 - RNA, 20 nt, Artificial Sequence
  Synthetic polynucleotide
ggccaggaugguucuuaggu

SEQ ID NO: 1124 - RNA, 20 nt, Artificial Sequence
  Synthetic polynucleotide
ucugguugcuggggcucaug

SEQ ID NO: 1125 - RNA, 20 nt, Artificial Sequence
  Synthetic polynucleotide
cuucuccccagcccugcucg

SEQ ID NO: 1126 - RNA, 20 nt, Artificial Sequence
  Synthetic polynucleotide
gguagguggggucggcgguc

SEQ ID NO: 1127 - RNA, 20 nt, Artificial Sequence
  Synthetic polynucleotide
uucucucuggaagggcacaa

SEQ ID NO: 1128 - RNA, 20 nt, Artificial Sequence
  Synthetic polynucleotide
ccuggccgucaucugcuccc

SEQ ID NO: 1129 - RNA, 20 nt, Artificial Sequence
  Synthetic polynucleotide
ugcagaucccacaggcgccc

SEQ ID NO: 1130 - RNA, 20 nt, Artificial Sequence
  Synthetic polynucleotide
cguugggcaguugugugaca

SEQ ID NO: 1131 - RNA, 20 nt, Artificial Sequence
  Synthetic polynucleotide
gucugggcggugcuacaacu

SEQ ID NO: 1132 - RNA, 20 nt, Artificial Sequence
  Synthetic polynucleotide
cuacaacugggcuggcggcc

SEQ ID NO: 1133 - RNA, 20 nt, Artificial Sequence
  Synthetic polynucleotide
cggucaccacgagcagggcu

SEQ ID NO: 1134 - RNA, 20 nt, Artificial Sequence
  Synthetic polynucleotide
uggcggccaggaugguucuu

SEQ ID NO: 1135 - RNA, 20 nt, Artificial Sequence
  Synthetic polynucleotide
ggcgcccuggccagucgucu

SEQ ID NO: 1136 - RNA, 20 nt, Artificial Sequence
  Synthetic polynucleotide
aggaugguucuuagguaggu

SEQ ID NO: 1137 - RNA, 20 nt, Artificial Sequence
  Synthetic polynucleotide
gcgugacuuccacaugagcg

SEQ ID NO: 1138 - RNA, 20 nt, Artificial Sequence
  Synthetic polynucleotide
cuccgccugagcaguggaga

SEQ ID NO: 1139 - RNA, 20 nt, Artificial Sequence
  Synthetic polynucleotide
agggcccggcgcaaugacag

SEQ ID NO: 1140 - RNA, 20 nt, Artificial Sequence
  Synthetic polynucleotide
gccugugggaucugcaugcc

SEQ ID NO: 1141 - RNA, 20 nt, Artificial Sequence
  Synthetic polynucleotide
ggugacaggugcggccucgg

SEQ ID NO: 1142 - RNA, 20 nt, Artificial Sequence
  Synthetic polynucleotide
gcccugcucguggugaccga

SEQ ID NO: 1143 - RNA, 20 nt, Artificial Sequence
  Synthetic polynucleotide
caguuccaaacccugguggu

SEQ ID NO: 1144 - RNA, 20 nt, Artificial Sequence
  Synthetic polynucleotide
cgauguguuggagaagcugc

SEQ ID NO: 1145 - RNA, 20 nt, Artificial Sequence
  Synthetic polynucleotide
gugucacacaacugcccaac

SEQ ID NO: 1146 - RNA, 20 nt, Artificial Sequence
  Synthetic polynucleotide
gcccuggccagucgucuggg

SEQ ID NO: 1147 - RNA, 20 nt, Artificial Sequence
  Synthetic polynucleotide
ccgggcuggcugcgguccuc

SEQ ID NO: 1148 - RNA, 20 nt, Artificial Sequence
  Synthetic polynucleotide
gcugcgguccucggggaagg

SEQ ID NO: 1149 - RNA, 20 nt, Artificial Sequence
  Synthetic polynucleotide
cgggcuggcugcgguccucg

SEQ ID NO: 1150 - RNA, 20 nt, Artificial Sequence
  Synthetic polynucleotide
accgcccagacgacuggcca

SEQ ID NO: 1151 - RNA, 20 nt, Artificial Sequence
  Synthetic polynucleotide
acagcggcaccuaccucugu

SEQ ID NO: 1152 - RNA, 20 nt, Artificial Sequence
  Synthetic polynucleotide
caagcuggccgccuuccccg

SEQ ID NO: 1153 - RNA, 20 nt, Artificial Sequence
  Synthetic polynucleotide
cucagcucaccccugccccg

SEQ ID NO: 1154 - RNA, 20 nt, Artificial Sequence
  Synthetic polynucleotide
auguggaagucacgcccguu

SEQ ID NO: 1155 - RNA, 20 nt, Artificial Sequence
  Synthetic polynucleotide
gagauggagagaggugagga

SEQ ID NO: 1156 - RNA, 20 nt, Artificial Sequence
  Synthetic polynucleotide
gaagguggcguuguccccuu

SEQ ID NO: 1157 - RNA, 20 nt, Artificial Sequence
  Synthetic polynucleotide
ugacacggaagcggcagucc

SEQ ID NO: 1158 - RNA, 20 nt, Artificial Sequence
  Synthetic polynucleotide
acccuggugguuggugucgu

SEQ ID NO: 1159 - RNA, 20 nt, Artificial Sequence
  Synthetic polynucleotide
cuuccacaugagcgugguca

SEQ ID NO: 1160 - RNA, 20 nt, Artificial Sequence
  Synthetic polynucleotide
cccugcucguggugaccgaa

SEQ ID NO: 1161 - RNA, 20 nt, Artificial Sequence
  Synthetic polynucleotide
agauggagagaggugaggaa

SEQ ID NO: 1162 - RNA, 20 nt, Artificial Sequence
  Synthetic polynucleotide
uccuggccgucaucugcucc

SEQ ID NO: 1163 - RNA, 20 nt, Artificial Sequence
  Synthetic polynucleotide
ggacccagacuagcagcacc

SEQ ID NO: 1164 - RNA, 20 nt, Artificial Sequence
  Synthetic polynucleotide
ugacguuaccucgugcggcc

SEQ ID NO: 1165 - RNA, 20 nt, Artificial Sequence
  Synthetic polynucleotide
cugagagauggagagaggug

SEQ ID NO: 1166 - RNA, 20 nt, Artificial Sequence
  Synthetic polynucleotide
gauggagagaggugaggaag

SEQ ID NO: 1167 - RNA, 20 nt, Artificial Sequence
  Synthetic polynucleotide
caccaggguuuggaacuggc

SEQ ID NO: 1168 - RNA, 20 nt, Artificial Sequence
  Synthetic polynucleotide
gcagggcuggggagaaggug

SEQ ID NO: 1169 - RNA, 20 nt, Artificial Sequence
  Synthetic polynucleotide
ggcucagcucaccccugccc

SEQ ID NO: 1170 - RNA, 20 nt, Artificial Sequence
  Synthetic polynucleotide
caccuaccuaagaaccaucc

SEQ ID NO: 1171 - RNA, 20 nt, Artificial Sequence
  Synthetic polynucleotide
agcagggcuggggagaaggu

SEQ ID NO: 1172 - RNA, 20 nt, Artificial Sequence
  Synthetic polynucleotide
acaugagcguggucagggcc

SEQ ID NO: 1173 - RNA, 20 nt, Artificial Sequence
  Synthetic polynucleotide
ucggucaccacgagcagggc

SEQ ID NO: 1174 - RNA, 20 nt, Artificial Sequence
  Synthetic polynucleotide
gggcccugaccacgcucaug

SEQ ID NO: 1175 - RNA, 20 nt, Artificial Sequence
  Synthetic polynucleotide
caccgcccagacgacuggcc

SEQ ID NO: 1176 - RNA, 20 nt, Artificial Sequence
  Synthetic polynucleotide
cuggcugcgguccucgggga

SEQ ID NO: 1177 - RNA, 20 nt, Artificial Sequence
  Synthetic polynucleotide
uuugugcccuuccagagaga

SEQ ID NO: 1178 - RNA, 20 nt, Artificial Sequence
  Synthetic polynucleotide
cgccugagcaguggagaagg

SEQ ID NO: 1179 - RNA, 20 nt, Artificial Sequence
  Synthetic polynucleotide
ggugcugcuagucugggucc

SEQ ID NO: 1180 - RNA, 20 nt, Artificial Sequence
  Synthetic polynucleotide
ggcacuucugcccuucucuc

SEQ ID NO: 1181 - RNA, 20 nt, Artificial Sequence
  Synthetic polynucleotide
acaaaggucagggguuagga

SEQ ID NO: 1182 - RNA, 20 nt, Artificial Sequence
  Synthetic polynucleotide
uucugcccuucucucuggaa

SEQ ID NO: 1183 - RNA, 20 nt, Artificial Sequence
  Synthetic polynucleotide
cauguggaagucacgcccgu

SEQ ID NO: 1184 - RNA, 20 nt, Artificial Sequence
  Synthetic polynucleotide
gugcggccucggaggccccg

SEQ ID NO: 1185 - RNA, 20 nt, Artificial Sequence
  Synthetic polynucleotide
gaucugcgccuugggggcca

SEQ ID NO: 1186 - RNA, 20 nt, Artificial Sequence
  Synthetic polynucleotide
cacucugguggggcugcucc

SEQ ID NO: 1187 - RNA, 20 nt, Artificial Sequence
  Synthetic polynucleotide
gaggugaggaaggggcuggg

SEQ ID NO: 1188 - RNA, 20 nt, Artificial Sequence
  Synthetic polynucleotide
acggaagcggcaguccuggc

SEQ ID NO: 1189 - RNA, 20 nt, Artificial Sequence
  Synthetic polynucleotide
cuggaagggcacaaagguca

SEQ ID NO: 1190 - RNA, 20 nt, Artificial Sequence
  Synthetic polynucleotide
gaggggcuggggugggcugu

SEQ ID NO: 1191 - RNA, 20 nt, Artificial Sequence
  Synthetic polynucleotide
acuuccacaugagcgugguc

SEQ ID NO: 1192 - RNA, 20 nt, Artificial Sequence
  Synthetic polynucleotide
ggucaccacgagcagggcug

SEQ ID NO: 1193 - RNA, 20 nt, Artificial Sequence
  Synthetic polynucleotide
cgccuugggggccagggaga

SEQ ID NO: 1194 - RNA, 20 nt, Artificial Sequence
  Synthetic polynucleotide
agccggccaguuccaaaccc

SEQ ID NO: 1195 - RNA, 20 nt, Artificial Sequence
  Synthetic polynucleotide
ugcggcccgggagcagauga

SEQ ID NO: 1196 - RNA, 20 nt, Artificial Sequence
  Synthetic polynucleotide
cccgaggaccgcagccagcc

SEQ ID NO: 1197 - RNA, 20 nt, Artificial Sequence
  Synthetic polynucleotide
guaacgucaucccagccccu

SEQ ID NO: 1198 - RNA, 20 nt, Artificial Sequence
  Synthetic polynucleotide
ggugucgugggcggccugcu

SEQ ID NO: 1199 - RNA, 20 nt, Artificial Sequence
  Synthetic polynucleotide
aucucucagacuccccagac

SEQ ID NO: 1200 - RNA, 20 nt, Artificial Sequence
  Synthetic polynucleotide
ggaugguucuuagguaggug

SEQ ID NO: 1201 - RNA, 20 nt, Artificial Sequence
  Synthetic polynucleotide
aggugccgcugucauugcgc

SEQ ID NO: 1202 - RNA, 20 nt, Artificial Sequence
  Synthetic polynucleotide
ugggaugacguuaccucgug

SEQ ID NO: 1203 - RNA, 20 nt, Artificial Sequence
  Synthetic polynucleotide
ucacccugagcucugcccgc

SEQ ID NO: 1204 - RNA, 20 nt, Artificial Sequence
  Synthetic polynucleotide
cggccaguuccaaacccugg

SEQ ID NO: 1205 - RNA, 20 nt, Artificial Sequence
  Synthetic polynucleotide
gcucagcucaccccugcccc

SEQ ID NO: 1206 - RNA, 20 nt, Artificial Sequence
  Synthetic polynucleotide
cgggcagagcucagggugac

SEQ ID NO: 1207 - RNA, 20 nt, Artificial Sequence
  Synthetic polynucleotide
ggugccgcugucauugcgcc

SEQ ID NO: 1208 - RNA, 20 nt, Artificial Sequence
  Synthetic polynucleotide
gcagccuggugcugcuaguc

SEQ ID NO: 1209 - RNA, 20 nt, Artificial Sequence
  Synthetic polynucleotide
uggaacuggccggcuggccu

SEQ ID NO: 1210 - RNA, 20 nt, Artificial Sequence
  Synthetic polynucleotide
gagcagggcuggggagaagg

SEQ ID NO: 1211 - RNA, 20 nt, Artificial Sequence
  Synthetic polynucleotide
cacgagcagggcuggggaga

SEQ ID NO: 1212 - RNA, 20 nt, Artificial Sequence
  Synthetic polynucleotide
ggaccgcagccagcccggcc

SEQ ID NO: 1213 - RNA, 20 nt, Artificial Sequence
  Synthetic polynucleotide
cagggcuggggagaaggugg

SEQ ID NO: 1214 - RNA, 20 nt, Artificial Sequence
  Synthetic polynucleotide
ccccuucggucaccacgagc

SEQ ID NO: 1215 - RNA, 20 nt, Artificial Sequence
  Synthetic polynucleotide
aucugcucccgggccgcacg

SEQ ID NO: 1216 - RNA, 20 nt, Artificial Sequence
  Synthetic polynucleotide
cuucugcccuucucucugga

SEQ ID NO: 1217 - RNA, 20 nt, Artificial Sequence
  Synthetic polynucleotide
agcuuguccgucugguugcu

SEQ ID NO: 1218 - RNA, 20 nt, Artificial Sequence
  Synthetic polynucleotide
ccucggaggccccggggcag

SEQ ID NO: 1219 - RNA, 20 nt, Artificial Sequence
  Synthetic polynucleotide
aggcggccagcuuguccguc

SEQ ID NO: 1220 - RNA, 20 nt, Artificial Sequence
  Synthetic polynucleotide
aggguuuggaacuggccggc

SEQ ID NO: 1221 - RNA, 20 nt, Artificial Sequence
  Synthetic polynucleotide
agagccugcgggcagagcuc

SEQ ID NO: 1222 - RNA, 20 nt, Artificial Sequence
  Synthetic polynucleotide
caaccaccaggguuuggaac

SEQ ID NO: 1223 - RNA, 20 nt, Artificial Sequence
  Synthetic polynucleotide
ucuggaagggcacaaagguc

SEQ ID NO: 1224 - RNA, 20 nt, Artificial Sequence
  Synthetic polynucleotide
ggccucggaggccccggggc

SEQ ID NO: 1225 - RNA, 20 nt, Artificial Sequence
  Synthetic polynucleotide
agagcucagggugacaggug

SEQ ID NO: 1226 - RNA, 20 nt, Artificial Sequence
  Synthetic polynucleotide
uccaggcaugcagaucccac

SEQ ID NO: 1227 - RNA, 20 nt, Artificial Sequence
  Synthetic polynucleotide
cagccuggugcugcuagucu

SEQ ID NO: 1228 - RNA, 20 nt, Artificial Sequence
  Synthetic polynucleotide
ggagauggccccacagaggu

SEQ ID NO: 1229 - RNA, 20 nt, Artificial Sequence
  Synthetic polynucleotide
aaaggucagggguuaggacg

SEQ ID NO: 1230 - RNA, 20 nt, Artificial Sequence
  Synthetic polynucleotide
caaaggucagggguuaggac

SEQ ID NO: 1231 - RNA, 20 nt, Artificial Sequence
  Synthetic polynucleotide
cuggugguuggugucguggg

SEQ ID NO: 1232 - RNA, 20 nt, Artificial Sequence
  Synthetic polynucleotide
cccgggagcagaugacggcc

SEQ ID NO: 1233 - RNA, 20 nt, Artificial Sequence
  Synthetic polynucleotide
cggagagcuucgugcuaaac

SEQ ID NO: 1234 - RNA, 20 nt, Artificial Sequence
  Synthetic polynucleotide
cacgaagcucuccgaugugu

SEQ ID NO: 1235 - RNA, 20 nt, Artificial Sequence
  Synthetic polynucleotide
ccccugccccggggccuccg

SEQ ID NO: 1236 - RNA, 20 nt, Artificial Sequence
  Synthetic polynucleotide
gggcuggggagaaggugggg

SEQ ID NO: 1237 - RNA, 20 nt, Artificial Sequence
  Synthetic polynucleotide
gagagaggugaggaaggggc

SEQ ID NO: 1238 - RNA, 20 nt, Artificial Sequence
  Synthetic polynucleotide
gggggguuccagggccuguc

SEQ ID NO: 1239 - RNA, 20 nt, Artificial Sequence
  Synthetic polynucleotide
uggugucgugggcggccugc

SEQ ID NO: 1240 - RNA, 20 nt, Artificial Sequence
  Synthetic polynucleotide
agggcuggggagaagguggg

SEQ ID NO: 1241 - RNA, 20 nt, Artificial Sequence
  Synthetic polynucleotide
ggugcggccucggaggcccc

SEQ ID NO: 1242 - RNA, 20 nt, Artificial Sequence
  Synthetic polynucleotide
agccccucacccaggccagc

SEQ ID NO: 1243 - RNA, 20 nt, Artificial Sequence
  Synthetic polynucleotide
gguucuuagguagguggggu

SEQ ID NO: 1244 - RNA, 20 nt, Artificial Sequence
  Synthetic polynucleotide
agcggcaguccuggccgggc

SEQ ID NO: 1245 - RNA, 20 nt, Artificial Sequence
  Synthetic polynucleotide
gggcacaaaggucagggguu

SEQ ID NO: 1246 - RNA, 20 nt, Artificial Sequence
  Synthetic polynucleotide
cagcuuguccgucugguugc

SEQ ID NO: 1247 - RNA, 20 nt, Artificial Sequence
  Synthetic polynucleotide
ccugggugaggggcuggggu

SEQ ID NO: 1248 - RNA, 20 nt, Artificial Sequence
  Synthetic polynucleotide
cgacaccaaccaccaggguu

SEQ ID NO: 1249 - RNA, 20 nt, Artificial Sequence
  Synthetic polynucleotide
cggaagcggcaguccuggcc

SEQ ID NO: 1250 - RNA, 20 nt, Artificial Sequence
  Synthetic polynucleotide
uuggaacuggccggcuggcc

SEQ ID NO: 1251 - RNA, 20 nt, Artificial Sequence
  Synthetic polynucleotide
ggagaagguggggggguucc

SEQ ID NO: 1252 - RNA, 20 nt, Artificial Sequence
  Synthetic polynucleotide
caggaugguucuuagguagg

SEQ ID NO: 1253 - RNA, 20 nt, Artificial Sequence
  Synthetic polynucleotide
gagaagguggggggguucca

SEQ ID NO: 1254 - RNA, 20 nt, Artificial Sequence
  Synthetic polynucleotide
cuggccggcuggccugggug

SEQ ID NO: 1255 - RNA, 20 nt, Artificial Sequence
  Synthetic polynucleotide
ugccgccuucuccacugcuc

SEQ ID NO: 1256 - RNA, 20 nt, Artificial Sequence
  Synthetic polynucleotide
aacugggcuggcggccagga

SEQ ID NO: 1257 - RNA, 20 nt, Artificial Sequence
  Synthetic polynucleotide
ggggguuccagggccugucu

SEQ ID NO: 1258 - RNA, 20 nt, Artificial Sequence
  Synthetic polynucleotide
ucaggcggaggugagcggaa

SEQ ID NO: 1259 - RNA, 20 nt, Artificial Sequence
  Synthetic polynucleotide
cucuuugaucugcgccuugg

SEQ ID NO: 1260 - RNA, 20 nt, Artificial Sequence
  Synthetic polynucleotide
gccgggcuggcugcgguccu

SEQ ID NO: 1261 - RNA, 20 nt, Artificial Sequence
  Synthetic polynucleotide
aggugcggccucggaggccc

SEQ ID NO: 1262 - RNA, 20 nt, Artificial Sequence
  Synthetic polynucleotide
ugaucugcgccuugggggcc

SEQ ID NO: 1263 - RNA, 20 nt, Artificial Sequence
  Synthetic polynucleotide
cagacuccccagacaggccc

SEQ ID NO: 1264 - RNA, 20 nt, Artificial Sequence
  Synthetic polynucleotide
cagcaaccagacggacaagc

SEQ ID NO: 1265 - RNA, 20 nt, Artificial Sequence
  Synthetic polynucleotide
ucucuuugaucugcgccuug

SEQ ID NO: 1266 - RNA, 20 nt, Artificial Sequence
  Synthetic polynucleotide
uugugcccuuccagagagaa

SEQ ID NO: 1267 - RNA, 20 nt, Artificial Sequence
  Synthetic polynucleotide
aguccuggccgggcuggcug

SEQ ID NO: 1268 - RNA, 20 nt, Artificial Sequence
  Synthetic polynucleotide
agagaggugaggaaggggcu

SEQ ID NO: 1269 - RNA, 20 nt, Artificial Sequence
  Synthetic polynucleotide
gcucucuuugaucugcgccu

SEQ ID NO: 1270 - RNA, 20 nt, Artificial Sequence
  Synthetic polynucleotide
cagggugacaggugcggccu

SEQ ID NO: 1271 - RNA, 20 nt, Artificial Sequence
  Synthetic polynucleotide
gccucggaggccccggggca

SEQ ID NO: 1272 - RNA, 20 nt, Artificial Sequence
  Synthetic polynucleotide
cucucuuugaucugcgccuu

SEQ ID NO: 1273 - RNA, 20 nt, Artificial Sequence
  Synthetic polynucleotide
gacguuaccucgugcggccc

SEQ ID NO: 1274 - RNA, 20 nt, Artificial Sequence
  Synthetic polynucleotide
aacccuggugguuggugucg

SEQ ID NO: 1275 - DNA, 1524 bp, Artificial Sequence
  Synthetic polynucleotide
atggcgcttccggtgacagcactgctcctccccttggcgctgttgctccacgcagcaaggccgcaggtccagttggtgcaaagcggggcggaggtgaaaaaacccggcgcttccgtgaaggtgtcctgtaaggcgtccggttatacgttcacgaactacgggatgaattgggttcgccaagcgccggggcagggactgaaatggatggggtggataaatacctacaccggcgaacctacatacgccgacgcttttaaagggcgagtcactatgacgcgcgataccagcatatccaccgcatacatggagctgtcccgactccggtcagacgacacggctgtctactattgtgctcgggactatggcgattatggcatggactactggggtcagggtacgactgtaacagttagtagtggtggaggcggcagtggcggggggggaagcggaggagggggttctggtgacatagttatgacccaatccccagatagtttggcggtttctctgggcgagagggcaacgattaattgtcgcgcatcaaagagcgtttcaacgagcggatattcttttatgcattggtaccagcaaaaacccggacaaccgccgaagctgctgatctacttggcttcaaatcttgagtctggggtgccggaccgattttctggtagtggaagcggaactgactttacgctcacgatcagttcactgcaggctgaggatgtagcggtctattattgccagcacagtagagaagtcccctggaccttcggtcaaggcacgaaagtagaaattaaaagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgcaaacggggcagaaagaaactcctgtatatattcaaacaaccatttatgagaccagtacaaactactcaagaggaagatggctgtagctgccgatttccagaagaagaagaaggaggatgtgaactgcgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1276 - protein, 508 aa, Artificial Sequence
  Synthetic polypeptide
MALPVTALLLPLALLLHAARPQVQLVQSGAEVKKPGASVKVSCKASGYTFTNYGMNWVRQAPGQGLKWMGWINTYTGEPTYADAFKGRVTMTRDTSISTAYMELSRLRSDDTAVYYCARDYGDYGMDYWGQGTTVTVSSGGGGSGGGGSGGGGSGDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKSAAAFVPVFLPAKPTTTPAPRPPTPAPTIASQPLSLRPEACRPAAGGAVHTRGLDFACDIYIWAPLAGTCGVLLLSLVITLYCNHRNRKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1277 - DNA, 20 bp, Artificial Sequence
  Synthetic polynucleotide
tgcccaggtagtatggcggt

SEQ ID NO: 1278 - DNA, 20 bp, Artificial Sequence
  Synthetic polynucleotide
acaccgctcccataaagcca

SEQ ID NO: 1279 - DNA, 20 bp, Artificial Sequence
  Synthetic polynucleotide
tggcttgccttggatttcag

SEQ ID NO: 1280 - DNA, 20 bp, Artificial Sequence
  Synthetic polynucleotide
gcacaaggctcagctgaacc

SEQ ID NO: 1281 - DNA, 20 bp, Artificial Sequence
  Synthetic polynucleotide
ttccatgctagcaatgcacg

SEQ ID NO: 1282 - DNA, 20 bp, Artificial Sequence
  Synthetic polynucleotide
gcacgtggcccagcctgctg

SEQ ID NO: 1283 - DNA, 20 bp, Artificial Sequence
  Synthetic polynucleotide
gtggtactggccagcagccg

SEQ ID NO: 1284 - DNA, 20 bp, Artificial Sequence
  Synthetic polynucleotide
gtgtgtgagtatgcatctcc

SEQ ID NO: 1285 - DNA, 20 bp, Artificial Sequence
  Synthetic polynucleotide
aggactgagggccatggaca

SEQ ID NO: 1286 - DNA, 20 bp, Artificial Sequence
  Synthetic polynucleotide
tccttgcagcagttagttcg

SEQ ID NO: 1287 - DNA, 20 bp, Artificial Sequence
  Synthetic polynucleotide
tcagaatctgggcacggttc

SEQ ID NO: 1288 - RNA, 20 nt, Artificial Sequence
  Synthetic polynucleotide
ugcccagguaguauggcggu

SEQ ID NO: 1289 - RNA, 20 nt, Artificial Sequence
  Synthetic polynucleotide
acaccgcucccauaaagcca

SEQ ID NO: 1290 - RNA, 20 nt, Artificial Sequence
  Synthetic polynucleotide
uggcuugccuuggauuucag

SEQ ID NO: 1291 - RNA, 20 nt, Artificial Sequence
  Synthetic polynucleotide
gcacaaggcucagcugaacc

SEQ ID NO: 1292 - RNA, 20 nt, Artificial Sequence
  Synthetic polynucleotide
uuccaugcuagcaaugcacg

SEQ ID NO: 1293 - RNA, 20 nt, Artificial Sequence
  Synthetic polynucleotide
gcacguggcccagccugcug

SEQ ID NO: 1294 - RNA, 20 nt, Artificial Sequence
  Synthetic polynucleotide
gugguacuggccagcagccg

SEQ ID NO: 1295 - RNA, 20 nt, Artificial Sequence
  Synthetic polynucleotide
gugugugaguaugcaucucc

SEQ ID NO: 1296 - RNA, 20 nt, Artificial Sequence
  Synthetic polynucleotide
aggacugagggccauggaca

SEQ ID NO: 1297 - RNA, 20 nt, Artificial Sequence
  Synthetic polynucleotide
uccuugcagcaguuaguucg

SEQ ID NO: 1298 - RNA, 20 nt, Artificial Sequence
  Synthetic polynucleotide
ucagaaucugggcacgguuc

SEQ ID NO: 1299 - DNA, 20 bp, Artificial Sequence
  Synthetic polynucleotide
ggctctcggagaatgacgag

SEQ ID NO: 1300 - DNA, 20 bp, Artificial Sequence
  Synthetic polynucleotide
cgactggccagggcgcctgt

SEQ ID NO: 1301 - DNA, 20 bp, Artificial Sequence
  Synthetic polynucleotide
ggggccactagggacaggat

SEQ ID NO: 1302 - DNA, 20 bp, Artificial Sequence
  Synthetic polynucleotide
gccagtagccagccccgtcc

SEQ ID NO: 1303 - DNA, 20 bp, Artificial Sequence
  Synthetic polynucleotide
ttacctgtaccataaccagg

SEQ ID NO: 1304 - DNA, 20 bp, Artificial Sequence
  Synthetic polynucleotide
cctactcaccatcagcctcc

SEQ ID NO: 1305 - DNA, 20 bp, Artificial Sequence
  Synthetic polynucleotide
tacctcggagcctctgaaga

SEQ ID NO: 1306 - DNA, 20 bp, Artificial Sequence
  Synthetic polynucleotide
tgtgctcttccaggtggttg

SEQ ID NO: 1307 - DNA, 20 bp, Artificial Sequence
  Synthetic polynucleotide
atcaaagctcgaaggcttgg

SEQ ID NO: 1308 - RNA, 20 nt, Artificial Sequence
  Synthetic polynucleotide
ggggccacuagggacaggau

SEQ ID NO: 1309 - RNA, 20 nt, Artificial Sequence
  Synthetic polynucleotide
uaccucggagccucugaaga

SEQ ID NO: 1310 - RNA, 20 nt, Artificial Sequence
  Synthetic polynucleotide
ugugcucuuccaggugguug

SEQ ID NO: 1311 - RNA, 20 nt, Artificial Sequence
  Synthetic polynucleotide
aucaaagcucgaaggcuugg

SEQ ID NO: 1312 - RNA, 20 nt, Artificial Sequence
  Synthetic polynucleotide
uuaccuguaccauaaccagg

SEQ ID NO: 1313 - DNA, 145 bp, Artificial Sequence
  Synthetic polynucleotide
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcct

SEQ ID NO: 1314 - DNA, 145 bp, Artificial Sequence
  Synthetic polynucleotide
aggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 1315 - DNA, 451 bp, Artificial Sequence
  Synthetic polynucleotide
ggccgccagtgtgatggatatctgcagaattcgcccttatggggatccgaacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctctatataagcagagctcgtttagtgaaccgtcagatcgcctggagacgccatccacgctgttttgacctccatagaagacaccgactctagag

SEQ ID NO: 1316 - DNA, 1518 bp, Artificial Sequence
  Synthetic polynucleotide
atgcttcttttggttacgtctctgttgctttgcgaacttcctcatccagcgttcttgctgatccccgatattcagatgactcagaccaccagtagcttgtctgcctcactgggagaccgagtaacaatctcctgcagggcaagtcaagacattagcaaatacctcaattggtaccagcagaagcccgacggaacggtaaaactcctcatctatcatacgtcaaggttgcattccggagtaccgtcacgattttcaggttctgggagcggaactgactattccttgactatttcaaacctcgagcaggaggacattgcgacatatttttgtcaacaaggtaataccctcccttacactttcggaggaggaaccaaactcgaaattaccgggtccaccagtggctctgggaagcctggcagtggagaaggttccactaaaggcgaggtgaagctccaggagagcggccccggtctcgttgcccccagtcaaagcctctctgtaacgtgcacagtgagtggtgtatcattgcctgattatggcgtctcctggataaggcagcccccgcgaaagggtcttgaatggcttggggtaatatggggctcagagacaacgtattataactccgctctcaaaagtcgcttgacgataataaaagataactccaagagtcaagttttccttaaaatgaacagtttgcagactgacgataccgctatatattattgtgctaaacattattactacggcggtagttacgcgatggattattgggggcaggggacttctgtcacagtcagtagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1317 - DNA, 66 bp, Artificial Sequence
  Synthetic polynucleotide
ggaagcggagctactaacttcagcctgctgaagcaggctggagacgtggaggagaaccctggacct

SEQ ID NO: 1318 - DNA, 720 bp, Artificial Sequence
  Synthetic polynucleotide
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 1319 - DNA, 49 bp, Artificial Sequence
  Synthetic polynucleotide
aataaaatcgctatccatcgaagatggatgtgtgttggttttttgtgtg

SEQ ID NO: 1320 - DNA, 700 bp, Artificial Sequence
  Synthetic polynucleotide
gaagcccagagcagggccttagggaagcgggaccctgctctgggcggaggaatatgtcccagatagcactggggactctttaaggaaagaaggatggagaaagagaaagggagtagaggcggccacgacctggtgaacacctaggacgcaccattctcacaaagggagttttccacacggacacccccctcctcaccacagccctgccaggacggggctggctactggccttatctcacaggtaaaactgacgcacggaggaacaatataaattggggactagaaaggtgaagagccaaagttagaactcaggaccaacttattctgattttgtttttccaaactgcttctcctcttgggaagtgtaaggaagctgcagcaccaggatcagtgaaacgcaccagacggccgcgtcagagcagctcaggttctgggagagggtagcgcagggtggccactgagaaccgggcaggtcacgcatcccccccttccctcccaccccctgccaagctctccctcccaggatcctctctggctccatcgtaagcaaaccttagaggttctggcaaggagagagatggctccaggaaatgggggtgtgtcaccagataaggaatctgcctaacaggaggtgggggttagacccaatatcaggagactaggaaggaggaggcctaaggatggggcttttctgtcacca

SEQ ID NO: 1321 - DNA, 700 bp, Artificial Sequence
  Synthetic polynucleotide
actgtggggtggaggggacagataaaagtacccagaaccagagccacattaaccggccctgggaatataaggtggtcccagctcggggacacaggatccctggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggc

SEQ ID NO: 1322 - DNA, 500 bp, Artificial Sequence
  Synthetic polynucleotide
gaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttca

SEQ ID NO: 1323 - DNA, 500 bp, Artificial Sequence
  Synthetic polynucleotide
tggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaaccc

SEQ ID NO: 1324 - DNA, 678 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatc

SEQ ID NO: 1325 - DNA, 800 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttca

SEQ ID NO: 1326 - DNA, 804 bp, Artificial Sequence
  Synthetic polynucleotide
tggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1327 - DNA, 1000 bp, Artificial Sequence
  Synthetic polynucleotide
taatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatc

SEQ ID NO: 1328 - DNA, 999 bp, Artificial Sequence
  Synthetic polynucleotide
ccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggagaagagcagcaggcatgagttgaatgaaggaggcagggccgggtcacaggg

SEQ ID NO: 1329 - DNA, 700 bp, Artificial Sequence
  Synthetic polynucleotide
ttttgtaaagaatataggtaaaaagtggcattttttctttggatttaattcttatggatttaagtcaacatgtattttcaagccaacaagttttgttaataagatggctgcaccctgctgctccatgccagatccaccacacagaaagcaaatgttcagtgcatctccctcttcctgtcagagcttatagaggaaggaagaccccgcaatgtggaggcatattgtattacaattacttttaatggcaaaaactgcagttacttttgtgccaacctactacatggtctggacagctaaatgtcatgtatttttcatggcccctccaggtattgtcagagtcctcttgtttggccttctaggaaggctgtgggacccagctttcttcaaccagtccaggtggaggcctctgccttgaacgtttccaagtgaggtaaaacccgcaggcccagaggcctctctacttcctgtgtggggttcagaaaccctcctcccctcccagcctcaggtgcctgcttcagaaaatggtgagtctctctcttataaagccctcctttttcatcctagcattgggaacaatggccccagggtccttatctctagcagatgttttgaaaaagtcatctgttttgctttttttccagaagtagtaagtctgctggcctccgccatcttagtaaagtaacagtcccatgaaacaaag

SEQ ID NO: 1330 - DNA, 700 bp, Artificial Sequence
  Synthetic polynucleotide
gtgagtaggatggagtggaaagggtggtgtgtctccagaccgctggaaggcttacagccttacctggcactgcctagtggcaccaaggagcctcatttaccagatgtaaggaactgtttgtgctatgttagggtgagggattagagctggggactaaagaaaaagataggccacgggtgcctgggagagcgttcggggagcaggcaaagaagagcagttggggtgatcatagctattgtgagcagagaggtctcgctacctctaagtacgagctcattccaacttacccagccctccagaactaacccaaaagagactggaagagcgaagctccactccttgttttgaagagaccagatacttgcgtccaaactctgcacagggcatatatagcaattcactatctttgagaccataaaacgcctcgtaatttttagtccttttcaagtgaccaacaactttcagtttatttcatttttttgaagcaagatggattatgaattgataaataaccaagagcatttctgtatctcatatgagataaataataccaaaaaaagttgccatttattgtcagatactgtgtaaagaaaaaattatttagacgtgttaactggtttaatcctacttctgcctaggaaggaaggtgttatatcctctttttaaaattctttttaattttgactatataaactgataa

SEQ ID NO: 1331 - DNA, 1178 bp, Artificial Sequence
  Synthetic polynucleotide
ggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 1332 - DNA, 66 bp, Artificial Sequence
  Synthetic polynucleotide
atgcttcttttggttacgtctctgttgctttgcgaacttcctcatccagcgttcttgctgatcccc

SEQ ID NO: 1333 - DNA, 732 bp, Artificial Sequence
  Synthetic polynucleotide
gatattcagatgactcagaccaccagtagcttgtctgcctcactgggagaccgagtaacaatctcctgcagggcaagtcaagacattagcaaatacctcaattggtaccagcagaagcccgacggaacggtaaaactcctcatctatcatacgtcaaggttgcattccggagtaccgtcacgattttcaggttctgggagcggaactgactattccttgactatttcaaacctcgagcaggaggacattgcgacatatttttgtcaacaaggtaataccctcccttacactttcggaggaggaaccaaactcgaaattaccgggtccaccagtggctctgggaagcctggcagtggagaaggttccactaaaggcgaggtgaagctccaggagagcggccccggtctcgttgcccccagtcaaagcctctctgtaacgtgcacagtgagtggtgtatcattgcctgattatggcgtctcctggataaggcagcccccgcgaaagggtcttgaatggcttggggtaatatggggctcagagacaacgtattataactccgctctcaaaagtcgcttgacgataataaaagataactccaagagtcaagttttccttaaaatgaacagtttgcagactgacgataccgctatatattattgtgctaaacattattactacggcggtagttacgcgatggattattgggggcaggggacttctgtcacagtcagt

SEQ ID NO: 1334 - protein, 245 aa, Artificial Sequence
  Synthetic polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 1335 - DNA, 261 bp, Artificial Sequence
  Synthetic polynucleotide
gctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgc

SEQ ID NO: 1336 - DNA, 120 bp, Artificial Sequence
  Synthetic polynucleotide
tcaaagcggagtaggttgttgcattccgattacatgaatatgactcctcgccggcctgggccgacaagaaaacattaccaaccctatgcccccccacgagacttcgctgcgtacaggtcc

SEQ ID NO: 1337 - DNA, 336 bp, Artificial Sequence
  Synthetic polynucleotide
cgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1338 - protein, 506 aa, Artificial Sequence
  Synthetic polypeptide
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1339 - DNA, 126 bp, Artificial Sequence
  Synthetic polynucleotide
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 1340 - protein, 42 aa, Artificial Sequence
  Synthetic polypeptide
KRGRKKLLYIFKQPFMRPVQTTQEEDGCSCRFPEEEEGGCEL

SEQ ID NO: 1341 - protein, 15 aa, Artificial Sequence
  Synthetic polypeptide
GGGGSGGGGSGGGGS

SEQ ID NO: 1342 - RNA, 100 nt, Artificial Sequence
  Synthetic polynucleotide
  misc_feature (1)..(4): Modified by 2'-O'methyl phosphorothioate linkage
  misc_feature (97)..(100): Modified by 2'-O'methyl phosphorothioate linkage
agagcaacagugcuguggccguuuuagagcuagaaauagcaaguuaaaauaaggcuaguccguuaucaacuugaaaaaguggcaccgagucggugcuuuu

SEQ ID NO: 1343 - RNA, 100 nt, Artificial Sequence; identical to SEQ ID NO: 1342
  Synthetic polynucleotide

SEQ ID NO: 1344 - RNA, 100 nt, Artificial Sequence
  Synthetic polynucleotide
  misc_feature (1)..(4): Modified by 2'-O'methyl phosphorothioate linkage
  misc_feature (97)..(100): Modified by 2'-O'methyl phosphorothioate linkage
gcuacucucucuuucuggccguuuuagagcuagaaauagcaaguuaaaauaaggcuaguccguuaucaacuugaaaaaguggcaccgagucggugcuuuu

SEQ ID NO: 1345 - RNA, 100 nt, Artificial Sequence; identical to SEQ ID NO: 1344
  Synthetic polynucleotide

SEQ ID NO: 1346 - RNA, 100 nt, Artificial Sequence
  Synthetic polynucleotide
  misc_feature (1)..(4): Modified by 2'-O'methyl phosphorothioate linkage
  misc_feature (97)..(100): Modified by 2'-O'methyl phosphorothioate linkage
ggggccacuagggacaggauguuuuagagcuagaaauagcaaguuaaaauaaggcuaguccguuaucaacuugaaaaaguggcaccgagucggugcuuuu

SEQ ID NO: 1347 - RNA, 100 nt, Artificial Sequence; identical to SEQ ID NO: 1346
  Synthetic polynucleotide

SEQ ID NO: 1348 - DNA, 4561 bp, Artificial Sequence
  Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcacgcgtgaagcccagagcagggccttagggaagcgggaccctgctctgggcggaggaatatgtcccagatagcactggggactctttaaggaaagaaggatggagaaagagaaagggagtagaggcggccacgacctggtgaacacctaggacgcaccattctcacaaagggagttttccacacggacacccccctcctcaccacagccctgccaggacggggctggctactggccttatctcacaggtaaaactgacgcacggaggaacaatataaattggggactagaaaggtgaagagccaaagttagaactcaggaccaacttattctgattttgtttttccaaactgcttctcctcttgggaagtgtaaggaagctgcagcaccaggatcagtgaaacgcaccagacggccgcgtcagagcagctcaggttctgggagagggtagcgcagggtggccactgagaaccgggcaggtcacgcatcccccccttccctcccaccccctgccaagctctccctcccaggatcctctctggctccatcgtaagcaaaccttagaggttctggcaaggagagagatggctccaggaaatgggggtgtgtcaccagataaggaatctgcctaacaggaggtgggggttagacccaatatcaggagactaggaaggaggaggcctaaggatggggcttttctgtcaccagccactagtggccgccagtgtgatggatatctgcagaattcgcccttatggggatccgaacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctctatataagcagagctcgtttagtgaaccgtcagatcgcctggagacgccatccacgctgttttgacctccatagaagacaccgactctagagggaccatgcttcttttggttacgtctctgttgctttgcgaacttcctcatccagcgttcttgctgatccccgatattcagatgactcagaccaccagtagcttgtctgcctcactgggagaccgagtaacaatctcctgcagggcaagtcaagacattagcaaatacctcaattggtaccagcagaagcccgacggaacggtaaaactcctcatctatcatacgtcaaggttgcattccggagtaccgtcacgattttcaggttctgggagcggaactgactattccttgactatttcaaacctcgagcaggaggacattgcgacatatttttgtcaacaaggtaataccctcccttacactttcggaggaggaaccaaactcgaaattaccgggtccaccagtggctctgggaagcctggcagtggagaaggttccactaaaggcgaggtgaagctccaggagagcggccccggtctcgttgcccccagtcaaagcctctctgtaacgtgcacagtgagtggtgtatcattgcctgattatggcgtctcctggataaggcagcccccgcgaaagggtcttgaatggcttggggtaatatggggctcagagacaacgtattataactccgctctcaaaagtcgcttgacgataataaaagataactccaagagtcaagttttccttaaaatgaacagtttgcagactgacgataccgctatatattattgtgctaaacattattactacggcggtagttacgcgatggattattgggggcaggggacttctgtcacagtcagtagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagaggaagcggagctactaacttcagcctgctgaagcaggctggagacgtggaggagaaccctggacctatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaataataaaataaaatcgctatccatcgaagatggatgtgtgttggttttttgtgtgactgtggggtggaggggacagataaaagtacccagaaccagagccacattaaccggccctgggaatataaggtggtcccagctcggggacacaggatccctggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggcggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1349 - DNA, 3158 bp, Artificial Sequence
  Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcacgcgtactagtggccgccagtgtgatggatatctgcagaattcgcccttatggggatccgaacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctctatataagcagagctcgtttagtgaaccgtcagatcgcctggagacgccatccacgctgttttgacctccatagaagacaccgactctagagggaccatgcttcttttggttacgtctctgttgctttgcgaacttcctcatccagcgttcttgctgatccccgatattcagatgactcagaccaccagtagcttgtctgcctcactgggagaccgagtaacaatctcctgcagggcaagtcaagacattagcaaatacctcaattggtaccagcagaagcccgacggaacggtaaaactcctcatctatcatacgtcaaggttgcattccggagtaccgtcacgattttcaggttctgggagcggaactgactattccttgactatttcaaacctcgagcaggaggacattgcgacatatttttgtcaacaaggtaataccctcccttacactttcggaggaggaaccaaactcgaaattaccgggtccaccagtggctctgggaagcctggcagtggagaaggttccactaaaggcgaggtgaagctccaggagagcggccccggtctcgttgcccccagtcaaagcctctctgtaacgtgcacagtgagtggtgtatcattgcctgattatggcgtctcctggataaggcagcccccgcgaaagggtcttgaatggcttggggtaatatggggctcagagacaacgtattataactccgctctcaaaagtcgcttgacgataataaaagataactccaagagtcaagttttccttaaaatgaacagtttgcagactgacgataccgctatatattattgtgctaaacattattactacggcggtagttacgcgatggattattgggggcaggggacttctgtcacagtcagtagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagaggaagcggagctactaacttcagcctgctgaagcaggctggagacgtggaggagaaccctggacctatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaataataaaataaaatcgctatccatcgaagatggatgtgtgttggttttttgtgtgggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1350 - DNA, 4879 bp, Artificial Sequence
  Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcacgcgtgaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatgcttcttttggttacgtctctgttgctttgcgaacttcctcatccagcgttcttgctgatccccgatattcagatgactcagaccaccagtagcttgtctgcctcactgggagaccgagtaacaatctcctgcagggcaagtcaagacattagcaaatacctcaattggtaccagcagaagcccgacggaacggtaaaactcctcatctatcatacgtcaaggttgcattccggagtaccgtcacgattttcaggttctgggagcggaactgactattccttgactatttcaaacctcgagcaggaggacattgcgacatatttttgtcaacaaggtaataccctcccttacactttcggaggaggaaccaaactcgaaattaccgggtccaccagtggctctgggaagcctggcagtggagaaggttccactaaaggcgaggtgaagctccaggagagcggccccggtctcgttgcccccagtcaaagcctctctgtaacgtgcacagtgagtggtgtatcattgcctgattatggcgtctcctggataaggcagcccccgcgaaagggtcttgaatggcttggggtaatatggggctcagagacaacgtattataactccgctctcaaaagtcgcttgacgataataaaagataactccaagagtcaagttttccttaaaatgaacagtttgcagactgacgataccgctatatattattgtgctaaacattattactacggcggtagttacgcgatggattattgggggcaggggacttctgtcacagtcagtagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagaggaagcggagctactaacttcagcctgctgaagcaggctggagacgtggaggagaaccctggacctatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaataataaaataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1351 - DNA, 3879 bp, Artificial Sequence
  Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcacgcgtggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatgcttcttttggttacgtctctgttgctttgcgaacttcctcatccagcgttcttgctgatccccgatattcagatgactcagaccaccagtagcttgtctgcctcactgggagaccgagtaacaatctcctgcagggcaagtcaagacattagcaaatacctcaattggtaccagcagaagcccgacggaacggtaaaactcctcatctatcatacgtcaaggttgcattccggagtaccgtcacgattttcaggttctgggagcggaactgactattccttgactatttcaaacctcgagcaggaggacattgcgacatatttttgtcaacaaggtaataccctcccttacactttcggaggaggaaccaaactcgaaattaccgggtccaccagtggctctgggaagcctggcagtggagaaggttccactaaaggcgaggtgaagctccaggagagcggccccggtctcgttgcccccagtcaaagcctctctgtaacgtgcacagtgagtggtgtatcattgcctgattatggcgtctcctggataaggcagcccccgcgaaagggtcttgaatggcttggggtaatatggggctcagagacaacgtattataactccgctctcaaaagtcgcttgacgataataaaagataactccaagagtcaagttttccttaaaatgaacagtttgcagactgacgataccgctatatattattgtgctaaacattattactacggcggtagttacgcgatggattattgggggcaggggacttctgtcacagtcagtagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagaggaagcggagctactaacttcagcctgctgaagcaggctggagacgtggaggagaaccctggacctatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaataataaaataaaatcgctatccatcgaagatggatgtgtgttggttttttgtgtgggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1352 - DNA, 4095 bp, Artificial Sequence
  Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcacgcgttttgtaaagaatataggtaaaaagtggcattttttctttggatttaattcttatggatttaagtcaacatgtattttcaagccaacaagttttgttaataagatggctgcaccctgctgctccatgccagatccaccacacagaaagcaaatgttcagtgcatctccctcttcctgtcagagcttatagaggaaggaagaccccgcaatgtggaggcatattgtattacaattacttttaatggcaaaaactgcagttacttttgtgccaacctactacatggtctggacagctaaatgtcatgtatttttcatggcccctccaggtattgtcagagtcctcttgtttggccttctaggaaggctgtgggacccagctttcttcaaccagtccaggtggaggcctctgccttgaacgtttccaagtgaggtaaaacccgcaggcccagaggcctctctacttcctgtgtggggttcagaaaccctcctcccctcccagcctcaggtgcctgcttcagaaaatggtgagtctctctcttataaagccctcctttttcatcctagcattgggaacaatggccccagggtccttatctctagcagatgttttgaaaaagtcatctgttttgctttttttccagaagtagtaagtctgctggcctccgccatcttagtaaagtaacagtcccatgaaacaaagatgcttcttttggttacgtctctgttgctttgcgaacttcctcatccagcgttcttgctgatccccgatattcagatgactcagaccaccagtagcttgtctgcctcactgggagaccgagtaacaatctcctgcagggcaagtcaagacattagcaaatacctcaattggtaccagcagaagcccgacggaacggtaaaactcctcatctatcatacgtcaaggttgcattccggagtaccgtcacgattttcaggttctgggagcggaactgactattccttgactatttcaaacctcgagcaggaggacattgcgacatatttttgtcaacaaggtaataccctcccttacactttcggaggaggaaccaaactcgaaattaccgggtccaccagtggctctgggaagcctggcagtggagaaggttccactaaaggcgaggtgaagctccaggagagcggccccggtctcgttgcccccagtcaaagcctctctgtaacgtgcacagtgagtggtgtatcattgcctgattatggcgtctcctggataaggcagcccccgcgaaagggtcttgaatggcttggggtaatatggggctcagagacaacgtattataactccgctctcaaaagtcgcttgacgataataaaagataactccaagagtcaagttttccttaaaatgaacagtttgcagactgacgataccgctatatattattgtgctaaacattattactacggcggtagttacgcgatggattattgggggcaggggacttctgtcacagtcagtagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagaggaagcggagctactaacttcagcctgctgaagcaggctggagacgtggaggagaaccctggacctatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaataataaaataaaatcgctatccatcgaagatggatgtgtgttggttttttgtgtggtgagtaggatggagtggaaagggtggtgtgtctccagaccgctggaaggcttacagccttacctggcactgcctagtggcaccaaggagcctcatttaccagatgtaaggaactgtttgtgctatgttagggtgagggattagagctggggactaaagaaaaagataggccacgggtgcctgggagagcgttcggggagcaggcaaagaagagcagttggggtgatcatagctattgtgagcagagaggtctcgctacctctaagtacgagctcattccaacttacccagccctccagaactaacccaaaagagactggaagagcgaagctccactccttgttttgaagagaccagatacttgcgtccaaactctgcacagggcatatatagcaattcactatctttgagaccataaaacgcctcgtaatttttagtccttttcaagtgaccaacaactttcagtttatttcatttttttgaagcaagatggattatgaattgataaataaccaagagcatttctgtatctcatatgagataaataataccaaaaaaagttgccatttattgtcagatactgtgtaaagaaaaaattatttagacgtgttaactggtttaatcctacttctgcctaggaaggaaggtgttatatcctctttttaaaattctttttaattttgactatataaactgataaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1353 - DNA, 2696 bp, Artificial Sequence
  Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcacgcgtatgcttcttttggttacgtctctgttgctttgcgaacttcctcatccagcgttcttgctgatccccgatattcagatgactcagaccaccagtagcttgtctgcctcactgggagaccgagtaacaatctcctgcagggcaagtcaagacattagcaaatacctcaattggtaccagcagaagcccgacggaacggtaaaactcctcatctatcatacgtcaaggttgcattccggagtaccgtcacgattttcaggttctgggagcggaactgactattccttgactatttcaaacctcgagcaggaggacattgcgacatatttttgtcaacaaggtaataccctcccttacactttcggaggaggaaccaaactcgaaattaccgggtccaccagtggctctgggaagcctggcagtggagaaggttccactaaaggcgaggtgaagctccaggagagcggccccggtctcgttgcccccagtcaaagcctctctgtaacgtgcacagtgagtggtgtatcattgcctgattatggcgtctcctggataaggcagcccccgcgaaagggtcttgaatggcttggggtaatatggggctcagagacaacgtattataactccgctctcaaaagtcgcttgacgataataaaagataactccaagagtcaagttttccttaaaatgaacagtttgcagactgacgataccgctatatattattgtgctaaacattattactacggcggtagttacgcgatggattattgggggcaggggacttctgtcacagtcagtagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagaggaagcggagctactaacttcagcctgctgaagcaggctggagacgtggaggagaaccctggacctatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaataataaaataaaatcgctatccatcgaagatggatgtgtgttggttttttgtgtgggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1354 - DNA, 4682 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatgcttcttttggttacgtctctgttgctttgcgaacttcctcatccagcgttcttgctgatccccgatattcagatgactcagaccaccagtagcttgtctgcctcactgggagaccgagtaacaatctcctgcagggcaagtcaagacattagcaaatacctcaattggtaccagcagaagcccgacggaacggtaaaactcctcatctatcatacgtcaaggttgcattccggagtaccgtcacgattttcaggttctgggagcggaactgactattccttgactatttcaaacctcgagcaggaggacattgcgacatatttttgtcaacaaggtaataccctcccttacactttcggaggaggaaccaaactcgaaattaccgggtccaccagtggctctgggaagcctggcagtggagaaggttccactaaaggcgaggtgaagctccaggagagcggccccggtctcgttgcccccagtcaaagcctctctgtaacgtgcacagtgagtggtgtatcattgcctgattatggcgtctcctggataaggcagcccccgcgaaagggtcttgaatggcttggggtaatatggggctcagagacaacgtattataactccgctctcaaaagtcgcttgacgataataaaagataactccaagagtcaagttttccttaaaatgaacagtttgcagactgacgataccgctatatattattgtgctaaacattattactacggcggtagttacgcgatggattattgggggcaggggacttctgtcacagtcagtagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1355 - DNA, 4560 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatcggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatgcttcttttggttacgtctctgttgctttgcgaacttcctcatccagcgttcttgctgatccccgatattcagatgactcagaccaccagtagcttgtctgcctcactgggagaccgagtaacaatctcctgcagggcaagtcaagacattagcaaatacctcaattggtaccagcagaagcccgacggaacggtaaaactcctcatctatcatacgtcaaggttgcattccggagtaccgtcacgattttcaggttctgggagcggaactgactattccttgactatttcaaacctcgagcaggaggacattgcgacatatttttgtcaacaaggtaataccctcccttacactttcggaggaggaaccaaactcgaaattaccgggtccaccagtggctctgggaagcctggcagtggagaaggttccactaaaggcgaggtgaagctccaggagagcggccccggtctcgttgcccccagtcaaagcctctctgtaacgtgcacagtgagtggtgtatcattgcctgattatggcgtctcctggataaggcagcccccgcgaaagggtcttgaatggcttggggtaatatggggctcagagacaacgtattataactccgctctcaaaagtcgcttgacgataataaaagataactccaagagtcaagttttccttaaaatgaacagtttgcagactgacgataccgctatatattattgtgctaaacattattactacggcggtagttacgcgatggattattgggggcaggggacttctgtcacagtcagtagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1356 - DNA, 3978 bp, Artificial Sequence
  Synthetic polynucleotide
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctgcggccgcacgcgtaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatcggaagcggagctactaacttcagcctgctgaagcaggctggagacgtggaggagaaccctggacccatgcttcttttggttacgtctctgttgctttgcgaacttcctcatccagcgttcttgctgatccccgatattcagatgactcagaccaccagtagcttgtctgcctcactgggagaccgagtaacaatctcctgcagggcaagtcaagacattagcaaatacctcaattggtaccagcagaagcccgacggaacggtaaaactcctcatctatcatacgtcaaggttgcattccggagtaccgtcacgattttcaggttctgggagcggaactgactattccttgactatttcaaacctcgagcaggaggacattgcgacatatttttgtcaacaaggtaataccctcccttacactttcggaggaggaaccaaactcgaaattaccgggtccaccagtggctctgggaagcctggcagtggagaaggttccactaaaggcgaggtgaagctccaggagagcggccccggtctcgttgcccccagtcaaagcctctctgtaacgtgcacagtgagtggtgtatcattgcctgattatggcgtctcctggataaggcagcccccgcgaaagggtcttgaatggcttggggtaatatggggctcagagacaacgtattataactccgctctcaaaagtcgcttgacgataataaaagataactccaagagtcaagttttccttaaaatgaacagtttgcagactgacgataccgctatatattattgtgctaaacattattactacggcggtagttacgcgatggattattgggggcaggggacttctgtcacagtcagtagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggagaagagcagcaggcatgagttgaatgaaggaggcagggccgggtcacagggtaaccacgtgcggaccgaggctgcagcgtcgtcctccctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 1357 - DNA, 4753 bp, Artificial Sequence
  Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcacgcgtaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatcggaagcggagctactaacttcagcctgctgaagcaggctggagacgtggaggagaaccctggacccatgcttcttttggttacgtctctgttgctttgcgaacttcctcatccagcgttcttgctgatccccgatattcagatgactcagaccaccagtagcttgtctgcctcactgggagaccgagtaacaatctcctgcagggcaagtcaagacattagcaaatacctcaattggtaccagcagaagcccgacggaacggtaaaactcctcatctatcatacgtcaaggttgcattccggagtaccgtcacgattttcaggttctgggagcggaactgactattccttgactatttcaaacctcgagcaggaggacattgcgacatatttttgtcaacaaggtaataccctcccttacactttcggaggaggaaccaaactcgaaattaccgggtccaccagtggctctgggaagcctggcagtggagaaggttccactaaaggcgaggtgaagctccaggagagcggccccggtctcgttgcccccagtcaaagcctctctgtaacgtgcacagtgagtggtgtatcattgcctgattatggcgtctcctggataaggcagcccccgcgaaagggtcttgaatggcttggggtaatatggggctcagagacaacgtattataactccgctctcaaaagtcgcttgacgataataaaagataactccaagagtcaagttttccttaaaatgaacagtttgcagactgacgataccgctatatattattgtgctaaacattattactacggcggtagttacgcgatggattattgggggcaggggacttctgtcacagtcagtagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagaggaagcggagctactaacttcagcctgctgaagcaggctggagacgtggaggagaaccctggacctatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaataataaaatcgctatccatcgaagatggatgtgtgttggttttttgtgtgccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggagaagagcagcaggcatgagttgaatgaaggaggcagggccgggtcacagggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1358 - DNA, 4682 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggatatagttatgacccaatcacccgatagtcttgcggtaagcctgggggagcgagcaacaataaactgtcgggcatcaaaatccgtcagtacaagcgggtattcattcatgcactggtatcaacagaaacccggtcagccacccaagctcctgatttatcttgcgtctaatcttgagtccggcgtcccagaccggttttccggctccgggagcggcacggattttactcttactatttctagccttcaggccgaagatgtggcggtatactactgccagcattcaagggaagttccttggacgttcggtcagggcacgaaagtggaaattaaaggcggggggggatccggcgggggagggtctggaggaggtggcagtggtcaggtccaactggtgcagtccggggcagaggtaaaaaaacccggcgcgtctgttaaggtttcatgcaaggccagtggatatactttcaccaattacggaatgaactgggtgaggcaggcccctggtcaaggcctgaaatggatgggatggataaacacgtacaccggtgaacctacctatgccgatgcctttaagggtcgggttacgatgacgagagacacctccatatcaacagcctacatggagctcagcagattgaggagtgacgatacggcagtctattactgtgcaagagactacggcgattatggcatggattactggggccagggcactacagtaaccgtttccagcagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1359 - DNA, 4682 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtccagttggtgcaaagcggggcggaggtgaaaaaacccggcgcttccgtgaaggtgtcctgtaaggcgtccggttatacgttcacgaactacgggatgaattgggttcgccaagcgccggggcagggactgaaatggatggggtggataaatacctacaccggcgaacctacatacgccgacgcttttaaagggcgagtcactatgacgcgcgataccagcatatccaccgcatacatggagctgtcccgactccggtcagacgacacggctgtctactattgtgctcgggactatggcgattatggcatggactactggggtcagggtacgactgtaacagttagtagtggtggaggcggcagtggcggggggggaagcggaggagggggttctggtgacatagttatgacccaatccccagatagtttggcggtttctctgggcgagagggcaacgattaattgtcgcgcatcaaagagcgtttcaacgagcggatattcttttatgcattggtaccagcaaaaacccggacaaccgccgaagctgctgatctacttggcttcaaatcttgagtctggggtgccggaccgattttctggtagtggaagcggaactgactttacgctcacgatcagttcactgcaggctgaggatgtagcggtctattattgccagcacagtagagaagtcccctggaccttcggtcaaggcacgaaagtagaaattaaaagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1360 - DNA, 4688 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtccagttggtgcaaagcggggcggaggtgaaaaaacccggcgcttccgtgaaggtgtcctgtaaggcgtccggttatacgttcacgaactacgggatgaattgggttcgccaagcgccggggcagggactgaaatggatggggtggataaatacctacaccggcgaacctacatacgccgacgcttttaaagggcgagtcactatgacgcgcgataccagcatatccaccgcatacatggagctgtcccgactccggtcagacgacacggctgtctactattgtgctcgggactatggcgattatggcatggactactggggtcagggtacgactgtaacagttagtagtggtggaggcggcagtggcggggggggaagcggaggagggggttctggtgacatagttatgacccaatccccagatagtttggcggtttctctgggcgagagggcaacgattaattgtcgcgcatcaaagagcgtttcaacgagcggatattcttttatgcattggtaccagcaaaaacccggacaaccgccgaagctgctgatctacttggcttcaaatcttgagtctggggtgccggaccgattttctggtagtggaagcggaactgactttacgctcacgatcagttcactgcaggctgaggatgtagcggtctattattgccagcacagtagagaagtcccctggaccttcggtcaaggcacgaaagtagaaattaaaagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgcaaacggggcagaaagaaactcctgtatatattcaaacaaccatttatgagaccagtacaaactactcaagaggaagatggctgtagctgccgatttccagaagaagaagaaggaggatgtgaactgcgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1361 - DNA, 4873 bp, Artificial Sequence
  Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcacgcgtgaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggctcttcctgtaaccgcacttctgcttcctcttgctctgctgcttcatgctgctagacctcaggtgcagttacaacagtcaggaggaggattagtgcagccaggaggatctctgaaactgtcttgtgccgccagcggaatcgattttagcaggtactggatgtcttgggtgagaagagcccctggaaaaggactggagtggatcggcgagattaatcctgatagcagcaccatcaactatgcccctagcctgaaggacaagttcatcatcagccgggacaatgccaagaacaccctgtacctgcaaatgagcaaggtgaggagcgaggatacagctctgtactactgtgccagcctgtactacgattacggagatgctatggactattggggccagggaacaagcgttacagtgtcttctggaggaggaggatccggtggtggtggttcaggaggtggaggttcgggagatattgtgatgacacaaagccagcggttcatgaccacatctgtgggcgacagagtgagcgtgacctgtaaagcttctcagtctgtggacagcaatgttgcctggtatcagcagaagcccagacagagccctaaagccctgatcttttctgccagcctgagattttctggcgttcctgccagatttaccggctctggctctggcaccgattttacactgaccatcagcaatctgcagtctgaggatctggccgagtacttttgccagcagtacaacaactaccccctgacctttggagctggcacaaaactggagctgaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagaggaagcggagctactaacttcagcctgctgaagcaggctggagacgtggaggagaaccctggacctatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaataataaaataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1362 - DNA, 4687 bp, Artificial Sequence
  Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggctcttcctgtaaccgcacttctgcttcctcttgctctgctgcttcatgctgctagacctcaggtgcagttacaacagtcaggaggaggattagtgcagccaggaggatctctgaaactgtcttgtgccgccagcggaatcgattttagcaggtactggatgtcttgggtgagaagagcccctggaaaaggactggagtggatcggcgagattaatcctgatagcagcaccatcaactatgcccctagcctgaaggacaagttcatcatcagccgggacaatgccaagaacaccctgtacctgcaaatgagcaaggtgaggagcgaggatacagctctgtactactgtgccagcctgtactacgattacggagatgctatggactattggggccagggaacaagcgttacagtgtcttctggaggaggaggatccggtggtggtggttcaggaggtggaggttcgggagatattgtgatgacacaaagccagcggttcatgaccacatctgtgggcgacagagtgagcgtgacctgtaaagcttctcagtctgtggacagcaatgttgcctggtatcagcagaagcccagacagagccctaaagccctgatcttttctgccagcctgagattttctggcgttcctgccagatttaccggctctggctctggcaccgattttacactgaccatcagcaatctgcagtctgaggatctggccgagtacttttgccagcagtacaacaactaccccctgacctttggagctggcacaaaactggagctgaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1363 - DNA, 4873 bp, Artificial Sequence
  Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcacgcgtgaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggctcttcctgtaaccgcacttctgcttcctcttgctctgctgcttcatgctgctagacctgacatcgtgatgacccaaagccagaggttcatgaccacatctgtgggcgatagagtgagcgtgacctgtaaagcctctcagtctgtggacagcaatgttgcctggtatcagcagaagcctagacagagccctaaagccctgatctttagcgccagcctgagatttagcggagttcctgccagatttaccggaagcggatctggaaccgattttacactgaccatcagcaacctgcagagcgaggatctggccgagtacttttgccagcagtacaacaattaccctctgacctttggagccggcacaaagctggagctgaaaggaggaggaggatctggtggtggtggttcaggaggtggaggttcgggacaagttcaattacagcaatctggaggaggactggttcagcctggaggaagcctgaagctgtcttgtgccgcttctggaatcgattttagcagatactggatgagctgggtgagaagagcccctggcaaaggactggagtggattggcgagattaatcctgatagcagcaccatcaactatgcccctagcctgaaggacaagttcatcatcagccgggacaatgccaagaacaccctgtacctgcaaatgagcaaggtgaggagcgaggatacagctctgtactactgtgccagcctgtactacgattacggagatgctatggactattggggccagggaacaagcgttacagtgagcagcagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagaggaagcggagctactaacttcagcctgctgaagcaggctggagacgtggaggagaaccctggacctatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaataataaaataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1364 - DNA, 4687 bp, Artificial Sequence
  Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggctcttcctgtaaccgcacttctgcttcctcttgctctgctgcttcatgctgctagacctgacatcgtgatgacccaaagccagaggttcatgaccacatctgtgggcgatagagtgagcgtgacctgtaaagcctctcagtctgtggacagcaatgttgcctggtatcagcagaagcctagacagagccctaaagccctgatctttagcgccagcctgagatttagcggagttcctgccagatttaccggaagcggatctggaaccgattttacactgaccatcagcaacctgcagagcgaggatctggccgagtacttttgccagcagtacaacaattaccctctgacctttggagccggcacaaagctggagctgaaaggaggaggaggatctggtggtggtggttcaggaggtggaggttcgggacaagttcaattacagcaatctggaggaggactggttcagcctggaggaagcctgaagctgtcttgtgccgcttctggaatcgattttagcagatactggatgagctgggtgagaagagcccctggcaaaggactggagtggattggcgagattaatcctgatagcagcaccatcaactatgcccctagcctgaaggacaagttcatcatcagccgggacaatgccaagaacaccctgtacctgcaaatgagcaaggtgaggagcgaggatacagctctgtactactgtgccagcctgtactacgattacggagatgctatggactattggggccagggaacaagcgttacagtgagcagcagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1365 - DNA, 4673 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggaggtccagctggtggagagcggcggaggactggtccagcctggcggctccctgaaactgagctgcgccgccagcggcatcgacttcagcaggtactggatgagctgggtgagacaggcccctggcaagggcctggaatggatcggcgagatcaaccccgactccagcaccatcaactacgccgacagcgtcaagggcaggttcaccattagcagggacaatgccaagaacaccctgtacctgcagatgaacctgagcagggccgaagacaccgccctgtactactgtgccagcctgtactacgactatggcgacgctatggactactggggccagggcaccctggtgacagtgagctccggaggaggcggcagcggcggaggcggcagcggcggaggcggcagcgacatccagatgacccagagccctagcagcctgagcgcctccgtgggagatagggtgacaatcacctgtagggccagccagagcgtggactccaacgtggcctggtatcaacagaagcccgagaaggcccccaagagcctgatcttttccgcctccctgaggttcagcggagtccccagcaggttctccggatccggctccggaaccgactttaccctgaccatctccagcctgcagcccgaggacttcgccacctactactgccagcagtacaacagctaccccctgaccttcggcgccggcacaaagctggagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1366 - DNA, 4679 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggaggtccagctggtggagagcggcggaggactggtccagcctggcggctccctgaaactgagctgcgccgccagcggcatcgacttcagcaggtactggatgagctgggtgagacaggcccctggcaagggcctggaatggatcggcgagatcaaccccgactccagcaccatcaactacgccgacagcgtcaagggcaggttcaccattagcagggacaatgccaagaacaccctgtacctgcagatgaacctgagcagggccgaagacaccgccctgtactactgtgccagcctgtactacgactatggcgacgctatggactactggggccagggcaccctggtgacagtgagctccggaggaggcggcagcggcggaggcggcagcggcggaggcggcagcgacatccagatgacccagagccctagcagcctgagcgcctccgtgggagatagggtgacaatcacctgtagggccagccagagcgtggactccaacgtggcctggtatcaacagaagcccgagaaggcccccaagagcctgatcttttccgcctccctgaggttcagcggagtccccagcaggttctccggatccggctccggaaccgactttaccctgaccatctccagcctgcagcccgaggacttcgccacctactactgccagcagtacaacagctaccccctgaccttcggcgccggcacaaagctggagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgcaaacggggcagaaagaaactcctgtatatattcaaacaaccatttatgagaccagtacaaactactcaagaggaagatggctgtagctgccgatttccagaagaagaagaaggaggatgtgaactgcgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1367 - DNA, 4673 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggaggtgcagctggtggagagcggaggaggactggtgcagcccggaggctccctgaagctgagctgcgctgcctccggcatcgacttcagcaggtactggatgagctgggtgaggcaggctcccggcaaaggcctggagtggatcggcgagatcaaccccgacagcagcaccatcaactacgccgacagcgtgaagggcaggttcaccatcagcagggacaacgccaagaataccctgtacctgcagatgaacctgagcagggccgaggacacagccctgtactactgtgccagcctgtactacgactatggagacgctatggactactggggccagggaaccctggtgaccgtgagcagcggaggcggaggctccggcggcggaggcagcggaggaggcggcagcgatatccagatgacccagtcccccagctccctgagcgctagccctggcgacagggtgagcgtgacatgcaaggccagccagagcgtggacagcaacgtggcctggtaccagcagaaacccagacaggcccccaaggccctgatcttcagcgccagcctgaggtttagcggcgtgcccgctaggtttaccggatccggcagcggcaccgacttcaccctgaccatctccaacctgcagtccgaggacttcgccacctactactgccagcagtacaacaactaccccctgacattcggcgccggaaccaagctggagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1368 - DNA, 4673 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggacatccagatgacccagagccctagcagcctgagcgctagcgtgggcgacagggtgaccatcacctgcagggccagccagagcgtggactccaacgtggcctggtaccagcagaagcccgagaaggcccccaagagcctgatcttcagcgccagcctgaggttctccggagtgcctagcagatttagcggcagcggcagcggcacagacttcaccctgaccatcagcagcctccagcccgaggatttcgccacctactactgccagcagtacaactcctaccccctgaccttcggcgccggcacaaagctggagatcaagggaggaggaggaagcggaggaggaggaagcggaggcggaggaagcgaggtgcagctggtggagtccggaggaggcctggtgcaacctggaggcagcctgaagctgagctgtgccgccagcggaatcgacttcagcaggtactggatgtcctgggtgagacaggcccctggcaagggcctggagtggatcggagagatcaaccccgacagctccaccatcaactacgccgacagcgtgaagggcaggttcaccatcagcagagacaacgccaagaacaccctgtacctgcagatgaacctgtccagagccgaggacaccgccctgtactactgcgccagcctgtattacgactacggcgacgctatggactactggggccagggcaccctggtgacagtgagcagcagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1369 - DNA, 4673 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggacatccaaatgacccagtcccctagcagcctgtccgccagccctggagacagggtgtccgtgacctgcaaggccagccagtccgtggacagcaacgtcgcctggtatcagcagaagcccaggcaagctcccaaggctctgatcttctccgccagcctgagattttccggcgtgcccgccagattcaccggaagcggcagcggcaccgacttcaccctgaccatcagcaacctgcagagcgaggatttcgccacatactactgccagcagtacaacaactaccccctgaccttcggagccggcaccaagctggagatcaaaggcggcggaggcagcggcggcggcggcagcggcggaggcggatccgaagtgcagctggtggaaagcggaggcggactcgtgcagcctggcggaagcctgaagctgagctgtgccgccagcggcatcgacttcagcaggtactggatgagctgggtgaggcaggctcccggcaaaggcctggagtggatcggcgagatcaaccctgacagcagcaccatcaactacgccgacagcgtgaaaggcaggttcaccatcagcagggacaacgccaagaacaccctgtacctgcagatgaacctgtccagagccgaggacaccgccctgtactactgcgccagcctgtactacgactacggcgacgctatggactactggggccaaggcaccctcgtgaccgtcagctccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1370 - DNA, 4682 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggaggtgcagctgcagcagtccggccctgagctcgtgaagcctggagccagcgtgaaaatgagctgtaaggcctccggcaacaccctcaccaactacgtgatccattggatgaagcagatgcccggccagggcctggactggattggctacattctgccctacaacgacctgaccaagtacaacgagaagttcaccggcaaggccaccctgaccagcgataagagctccagcagcgcctacatggagctgaactccctgaccagcgaggacagcgccgtgtactactgcaccaggtgggactgggatggcttcttcgacccctggggacagggcaccaccctgacagtgtccagcggaggaggcggcagcggcggcggcggctccggcggcggcggcagcgatatcgtgatgacacagtcccctctgagcctgcctgtgagcctgggcgaccaggccagcatcagctgcaggtccacccagtccctggtgcactccaacggcaacacccacctgcactggtacctgcaaaggcccggccagtcccctaagctgctgatctacagcgtgagcaacaggtttagcgaggtgcccgatagattttccgccagcggcagcggcaccgacttcacactgaagatctccagggtggaggccgaggatctgggcgtgtacttctgcagccagaccagccacatcccctacaccttcggcggcggaaccaagctggagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1371 - DNA, 4682 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggacatcgtgatgacccagagccccctgagcctgcctgtgtccctgggagaccaggcttccatcagctgcaggtccacccagagcctggtgcactccaacggcaacacccacctgcactggtacctgcagaggcctggccagtcccccaagctgctgatctacagcgtgagcaataggttcagcgaggtgcccgacagattcagcgccagcggaagcggcaccgacttcaccctgaagatcagcagggtcgaggccgaagatctgggcgtgtacttctgctcccagacatcccacatcccttacaccttcggcggcggcaccaagctggagattaagggcggcggaggatccggcggaggaggatccggaggaggaggaagcgaggtgcagctgcagcagagcggacccgagctggtgaaacccggagccagcgtcaaaatgagctgcaaggccagcggcaacaccctgaccaactacgtcatccactggatgaagcagatgcccggacagggcctggactggatcggctacatcctgccctacaacgacctgaccaagtacaacgagaaattcaccggcaaggccaccctgaccagcgacaagagcagcagcagcgcctacatggagctgaacagcctgaccagcgaggactccgccgtgtactattgcaccaggtgggactgggacggcttctttgacccctggggccagggcacaacactcaccgtgagctccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1372 - DNA, 4682 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtgcagctggtgcagagcggagccgagctcaagaagcccggagcctccgtgaaggtgagctgcaaggccagcggcaacaccctgaccaactacgtgatccactgggtgagacaagcccccggccaaaggctggagtggatgggctacatcctgccctacaacgacctgaccaagtacagccagaagttccagggcagggtgaccatcaccagggataagagcgcctccaccgcctatatggagctgagcagcctgaggagcgaggacaccgctgtgtactactgtacaaggtgggactgggacggcttctttgacccctggggccagggcacaacagtgaccgtcagcagcggcggcggaggcagcggcggcggcggcagcggcggaggcggaagcgaaatcgtgatgacccagagccccgccacactgagcgtgagccctggcgagagggccagcatctcctgcagggctagccaaagcctggtgcacagcaacggcaacacccacctgcactggtaccagcagagacccggacaggctcccaggctgctgatctacagcgtgagcaacaggttctccgaggtgcctgccaggtttagcggcagcggaagcggcaccgactttaccctgaccatcagcagcgtggagtccgaggacttcgccgtgtattactgcagccagaccagccacatcccttacaccttcggcggcggcaccaagctggagatcaaaagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1373 - DNA, 4688 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtgcagctggtgcagagcggagccgagctcaagaagcccggagcctccgtgaaggtgagctgcaaggccagcggcaacaccctgaccaactacgtgatccactgggtgagacaagcccccggccaaaggctggagtggatgggctacatcctgccctacaacgacctgaccaagtacagccagaagttccagggcagggtgaccatcaccagggataagagcgcctccaccgcctatatggagctgagcagcctgaggagcgaggacaccgctgtgtactactgtacaaggtgggactgggacggcttctttgacccctggggccagggcacaacagtgaccgtcagcagcggcggcggaggcagcggcggcggcggcagcggcggaggcggaagcgaaatcgtgatgacccagagccccgccacactgagcgtgagccctggcgagagggccagcatctcctgcagggctagccaaagcctggtgcacagcaacggcaacacccacctgcactggtaccagcagagacccggacaggctcccaggctgctgatctacagcgtgagcaacaggttctccgaggtgcctgccaggtttagcggcagcggaagcggcaccgactttaccctgaccatcagcagcgtggagtccgaggacttcgccgtgtattactgcagccagaccagccacatcccttacaccttcggcggcggcaccaagctggagatcaaaagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgcaaacggggcagaaagaaactcctgtatatattcaaacaaccatttatgagaccagtacaaactactcaagaggaagatggctgtagctgccgatttccagaagaagaagaaggaggatgtgaactgcgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1374 - DNA, 4682 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtgcagctggtgcagagcggcgccgagctgaagaaacctggcgccagcgtcaaggtgagctgcaaggcttccggaaacaccctcaccaactacgtgatccactgggtgaggcaggcccccggacagagactggagtggatgggctacattctgccctacaacgacctgaccaagtacagccagaagttccagggcagggtcaccatcaccagggacaagagcgccagcaccgcctacatggagctgagcagcctgaggtccgaggacacagccgtgtactactgcaccaggtgggactgggacggattcttcgacccttggggccaaggcaccacagtgacagtgagctccggcggaggcggcagcggcggcggaggaagcggcggcggcggaagcgacatcgtgatgacccagagccctctgagcctgcccgtgacactgggacagcctgccacactgtcctgcaggagcacccagagcctggtgcatagcaacggcaacacccacctgcactggttccagcagagacctggccagagccccctgagactgatctacagcgtgagcaacagggacagcggcgtgcccgatagatttagcggcagcggcagcggcaccgactttaccctgaaaatctccagggtggaggccgaggatgtgggcgtgtattactgctcccagacaagccacattccctatacattcggcggcggcaccaagctggagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1375 - DNA, 4682 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggaaatcgtgatgacccagagccctgccacactgagcgtgagccctggcgagagagccagcatcagctgcagggcctcccagagcctggtgcactccaacggcaatacccacctgcactggtatcagcagagacccggccaggcccctaggctgctgatctactccgtgagcaacaggttctccgaggtgcccgccagattcagcggatccggcagcggcaccgacttcaccctcaccatctccagcgtggagagcgaggacttcgccgtctactactgcagccagacaagccacatcccctacaccttcggcggcggcaccaagctggagatcaagggcggcggcggcagcggcggcggaggcagcggaggcggcggatcccaggtgcaactggtgcagagcggagccgagctgaagaagcccggagccagcgtgaaggtcagctgcaaggccagcggcaacaccctgacaaactacgtgatccactgggtgaggcaggcccctggccaaaggctcgagtggatgggctacatcctcccctacaacgacctgaccaagtactcccagaagttccagggcagggtgaccatcaccagggataagagcgccagcaccgcctacatggaactcagcagcctgaggagcgaggacaccgccgtgtactactgcaccaggtgggactgggatggcttcttcgacccttggggccagggcaccaccgtgacagtgagctccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1376 - DNA, 4682 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggacatcgtgatgacacaatcccccctcagcctgcctgtgacactgggccagcctgccaccctgagctgcaggagcacccagtccctggtgcactccaacggcaacacccacctgcactggttccagcagaggcctggacagagccccctgaggctgatctacagcgtgagcaacagggactccggcgtgcccgatagattcagcggcagcggctccggcaccgatttcaccctgaagatctccagagtggaagccgaggacgtgggcgtctactactgcagccagaccagccatatcccctacaccttcggcggcggcaccaagctggagatcaagggaggcggcggaagcggcggaggcggatccggaggcggaggctcccaagtgcagctggtgcagagcggcgctgagctgaagaagcccggagccagcgtgaaggtgagctgcaaggccagcggaaacaccctgaccaactacgtgatccactgggtgagacaggcccccggacagagactcgagtggatgggctacatcctgccctacaacgacctgaccaagtacagccagaagttccagggcagggtgacaatcaccagggacaagagcgccagcaccgcctacatggagctgagcagcctgagatccgaggacaccgccgtgtactactgcaccaggtgggactgggacggcttctttgacccctggggccagggaaccacagtgaccgtgtcctccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1377 - DNA, 4658 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggaggtgcagctgcagcagagcggccctgagctggtgaagcccggcgccagcgtgaagatcagctgcaagacctccggctatacctttaccgagtacaccatcaactgggtgaagcagagccacggcaagagcctggagtggatcggcgatatctaccccgacaactacaacatcaggtacaaccagaagttcaagggcaaggccaccctgaccgtggacaagtccagcagcaccgcctacatggagctgaggagcctgtccagcgaggactccgccatctactactgcgccaaccacgactttttcgtcttctggggacagggcaccctggtgacagtgtccgctggcggcggcggcagcggcggcggcggctccggaggcggcggcagcgacatccagatgacacaggccacaagctccctgtccgccagcctgggcgatagggtgaccatcaattgcaggacctcccaggacatcagcaaccacctgaactggtaccagcagaaacccgacggcaccgtgaagctgctcatctactacaccagcaggctgcagtccggcgtccctagcagattcagcggatccggcagcggcaccgactatagcctgaccatcagcaacctcgagcaggaggacatcggcacctacttctgccatcagggcaacaccctgccccctacctttggcggcggcacaaagctggagattaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1378 - DNA, 4658 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggatatccagatgacccaggccaccagcagcctgagcgcttccctcggcgacagggtgaccatcaactgcaggaccagccaggacatctccaaccacctgaactggtaccagcagaagcccgacggcaccgtgaaactgctgatctactacaccagcagactgcagagcggcgtgccctccagattttccggcagcggctccggcaccgactacagcctgaccattagcaacctggagcaggaggacatcggaacctacttctgccaccagggcaacacactgcctcccaccttcggcggcggcacaaagctcgagatcaagggcggcggcggaagcggcggcggcggcagcggcggcggaggctccgaggtgcaactgcaacagagcggacctgagctggtgaagcctggcgccagcgtgaagatctcctgtaagaccagcggctacaccttcaccgagtacaccatcaactgggtgaagcagagccacggcaagagcctcgaatggatcggcgacatctatcccgacaactacaatatcagatacaaccagaagttcaagggaaaggccaccctgaccgtggataagtcctcctccaccgcttacatggagctgaggagcctgagcagcgaggactccgccatctactactgcgccaaccacgacttcttcgtgttctggggccaaggcaccctcgtgaccgtgagcgccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1379 - DNA, 4658 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtgcagctggtgcagtccggcgctgagctgaagaagcccggcgccagcgtgaagatcagctgcaaggccagcggctacaccttcaccgaatacaccatcaactgggtgagacaggcccctggacagaggctcgagtggatgggcgacatctaccccgacaactacagcatcaggtacaaccagaagttccagggcagggtgacaatcaccagggacaccagcgccagcaccgcctatatggagctgagcagcctgagatccgaggacaccgccgtctattactgcgccaaccacgacttcttcgtgttctggggccagggaacactggtgaccgtgtccagcggcggcggcggcagcggcggcggaggaagcggcggcggcggcagcgatatccagatgacccagagcccctcctccctgagcgctagcgtgggcgacagggtgaccattacctgtcaggcctcccaggacatcagcaactacctgaactggtaccagcagaagcctggcaaggcccccaagctgctgatctattacaccagcaggctggagaccggcgtgccctccagattcagcggctccggctccggaaccgacttcaccttcaccatcagctccctgcagcctgaggacatcgccacctactactgccagcagggcaacaccctgcctcccacattcggcggcggcacaaaggtggagatcaaaagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1380 - DNA, 4658 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtgcagctggtccagtccggcgccgaactgaagaagcctggcgccagcgtgaagatcagctgcaaggcctccggctacaccttcaccgagtacaccatcaactgggtgaggcaagcccccggccagagactggagtggatgggcgacatctaccccgacaactacagcatcaggtacaaccagaagttccagggcagggtgacaatcaccagggataccagcgccagcacagcctatatggagctgtcctccctgagatccgaggacaccgccgtgtattactgcgccaaccacgacttcttcgtgttctggggccaaggcaccctggtgaccgtgagcagcggcggcggcggctccggcggcggaggctccggaggcggaggcagcgacatccagatgacccagagcccttccagcctgagcgctagcctgggcgacagggtgaccatcacctgcaggaccagccaggacatcagcaatcacctgaactggtaccagcaaaagcccggcaaggcccctaagctgctgatctactacaccagcaggctggaaagcggcgtgcctagcaggttcagcggcagcggctccggaaccgactacagcctgaccattagcagcctgcaacctgaggacatcggcacctattactgccagcagggcaacaccctgcctcctacctttggcggcggcaccaaactcgagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1381 - DNA, 4658 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtgcagctggtgcagagcggccctgagctgaagaagcccggagccagcgtgaagatctcctgcaagacctccggctacaccttcaccgagtacaccatcaactgggtgaagcaggcccccggacagggactggaatggatcggcgacatctaccccgacaactacaacatcaggtacaaccagaagttccaaggcaaggccaccatcacaagggacaccagcagcagcaccgcctacatggagctgagcagcctgaggagcgaggataccgccgtgtactactgcgccaaccacgacttcttcgtgttctggggccagggcaccctggtgacagtgagcagcggaggaggcggaagcggaggaggaggatccggaggaggaggcagcgacatccagatgacccagtccccctcctccctgagcgcctccgtgggagacagggtgaccatcacctgccaggccagccaggacatcagcaactacctgaactggtaccagcagaagcccggcaaggcccccaagctgctgatttactacaccagcaggctggaaaccggcgtgcccagcagatttagcggcagcggcagcggcaccgactttacctttaccatctccagcctgcagcccgaggatatcgccacatactactgccagcagggcaacaccctcccccctacctttggcggcggcaccaaggtggagattaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1382 - DNA, 4658 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtgcagctggtgcagtccggccccgaactgaaaaagcccggcgccagcgtcaagatcagctgcaagacctccggctacaccttcaccgagtacaccatcaactgggtgaagcaggcccccggccagggactggaatggattggcgacatctaccccgacaactacaacattaggtataaccagaagttccagggcaaggccaccatcacaagagacaccagcagcagcaccgcctacatggagctgagcagcctgaggagcgaggacaccgccgtgtactactgcgccaaccacgacttcttcgtgttctggggccagggaaccctggtgacagtgtccagcggcggcggcggctccggcggcggcggctccggcggcggcggcagcgacattcagatgacacagagcccctccagcctgagcgccagcctgggcgatagggtgaccatcacctgcagaaccagccaggacatcagcaaccacctgaattggtaccagcagaagcccggaaaggcccccaaactgctgatctactacaccagcaggctggagagcggcgtgcctagcaggtttagcggcagcggcagcggcacagattacagcctgaccatcagcagcctgcagcccgaagacatcggcacctactactgccagcagggcaacaccctgccccctacctttggcggaggcaccaagctggagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1383 - DNA, 4658 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggacatccagatgacacagagccctagcagcctgagcgcttccgtgggcgacagggtgaccatcacctgccaggccagccaggacatcagcaactacctcaactggtaccagcagaagcccggcaaggcccctaagctgctgatctactacacctccaggctggagaccggagtgccctccagattttccggcagcggcagcggcaccgatttcaccttcaccatcagcagcctgcagcccgaggacatcgccacctactattgccagcagggcaacaccctgccccccacatttggaggcggcaccaaggtggagatcaagggcggaggaggaagcggaggaggaggaagcggaggaggcggaagccaggtgcagctggtgcagagcggcgctgagctcaagaagcctggcgccagcgtgaagatcagctgcaaagcctccggatacaccttcaccgagtacaccatcaattgggtgagacaggcccccggccaaagactggagtggatgggcgacatctatcccgacaactacagcatcaggtacaaccagaagttccagggcagggtgacaatcaccagagacaccagcgccagcaccgcctacatggagctgagcagcctgaggagcgaggacaccgccgtgtactactgcgccaatcacgacttcttcgtgttctggggccagggaaccctggtgaccgtcagctccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1384 - DNA, 4658 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggatatccagatgacacagagccctagctccctgagcgccagcctgggcgatagggtgaccatcacctgcaggacctcccaggacatcagcaaccacctgaactggtaccagcagaagcccggcaaagcccccaagctgctgatctactacaccagcaggctggaaagcggcgtgcccagcaggtttagcggaagcggcagcggcaccgactacagcctgaccatcagctccctgcagcccgaggacatcggcacctactactgccagcagggcaacaccctgcctcccaccttcggaggcggaaccaagctggagattaagggaggcggcggaagcggcggcggcggctccggcggaggaggcagccaggtgcagctggtgcagtccggagccgagctgaaaaagcctggcgccagcgtgaagatcagctgcaaggccagcggctacaccttcaccgagtacaccatcaactgggtgaggcaggcccctggccagagactcgagtggatgggcgacatctaccccgacaactactccatcaggtacaaccagaagtttcagggcagggtgaccattaccagggacaccagcgccagcacagcctacatggagctgagcagcctgaggagcgaggatacagccgtctactactgcgccaaccacgactttttcgtgttctggggacagggcaccctggtgaccgtgtcctccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1385 - DNA, 4658 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggacatccaaatgacccagagccctagctccctgagcgcttccgtgggcgacagagtgaccattacctgccaggccagccaggacatcagcaactacctgaactggtatcagcagaagcctggcaaggcccccaagctgctgatctactacaccagcaggctggagaccggagtgcccagcaggtttagcggctccggatccggcaccgacttcaccttcaccatctccagcctgcagcccgaggacatcgccacctactactgccagcagggcaataccctcccccctaccttcggaggcggcaccaaggtggagatcaagggcggcggcggctccggcggcggcggcagcggcggaggcggcagccaggtgcaactggtgcagagcggccctgagctgaagaaacccggcgccagcgtgaaaatcagctgcaagaccagcggctacacattcaccgagtacaccatcaactgggtgaagcaggctcccggacagggactggagtggatcggcgacatctaccctgacaactacaacatcagatacaaccaaaagttccagggcaaggccaccatcaccagggacaccagctcctccaccgcctacatggagctgagcagcctgaggagcgaggacaccgctgtgtactactgcgccaaccacgacttcttcgtgttctggggccagggaaccctggtgaccgtgagcagcagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1386 - DNA, 4658 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggatatccagatgacacaaagccccagcagcctgtccgctagcctgggcgatagggtgaccatcacatgcaggaccagccaggacatctccaaccacctgaactggtaccagcagaagcctggaaaggcccccaaactgctgatctactacaccagcaggctggagagcggcgtgcctagcaggttttccggcagcggcagcggcaccgactatagcctgaccatcagctccctgcagcccgaggacatcggcacctactactgccagcagggaaacacactgccccccacctttggcggcggcacaaagctggagatcaagggcggcggcggatccggcggcggaggcagcggaggaggaggaagccaggtgcagctggtgcagtccggccctgagctgaagaagcccggagccagcgtgaaaattagctgcaagacctccggctacacattcaccgagtacaccatcaactgggtgaagcaggctcccggccagggactggagtggatcggcgacatctaccccgacaactacaacatcaggtacaaccagaaattccagggcaaggccaccatcaccagggacaccagctcctccaccgcctatatggagctgtccagcctgagaagcgaggataccgccgtgtactactgcgccaaccacgatttcttcgtgttctggggccagggcacactggtcaccgtgagcagcagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1387 - DNA, 4224 bp, Artificial Sequence
  Synthetic polynucleotide
gaagcccagagcagggccttagggaagcgggaccctgctctgggcggaggaatatgtcccagatagcactggggactctttaaggaaagaaggatggagaaagagaaagggagtagaggcggccacgacctggtgaacacctaggacgcaccattctcacaaagggagttttccacacggacacccccctcctcaccacagccctgccaggacggggctggctactggccttatctcacaggtaaaactgacgcacggaggaacaatataaattggggactagaaaggtgaagagccaaagttagaactcaggaccaacttattctgattttgtttttccaaactgcttctcctcttgggaagtgtaaggaagctgcagcaccaggatcagtgaaacgcaccagacggccgcgtcagagcagctcaggttctgggagagggtagcgcagggtggccactgagaaccgggcaggtcacgcatcccccccttccctcccaccccctgccaagctctccctcccaggatcctctctggctccatcgtaagcaaaccttagaggttctggcaaggagagagatggctccaggaaatgggggtgtgtcaccagataaggaatctgcctaacaggaggtgggggttagacccaatatcaggagactaggaaggaggaggcctaaggatggggcttttctgtcaccagccactagtggccgccagtgtgatggatatctgcagaattcgcccttatggggatccgaacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctctatataagcagagctcgtttagtgaaccgtcagatcgcctggagacgccatccacgctgttttgacctccatagaagacaccgactctagagggaccatgcttcttttggttacgtctctgttgctttgcgaacttcctcatccagcgttcttgctgatccccgatattcagatgactcagaccaccagtagcttgtctgcctcactgggagaccgagtaacaatctcctgcagggcaagtcaagacattagcaaatacctcaattggtaccagcagaagcccgacggaacggtaaaactcctcatctatcatacgtcaaggttgcattccggagtaccgtcacgattttcaggttctgggagcggaactgactattccttgactatttcaaacctcgagcaggaggacattgcgacatatttttgtcaacaaggtaataccctcccttacactttcggaggaggaaccaaactcgaaattaccgggtccaccagtggctctgggaagcctggcagtggagaaggttccactaaaggcgaggtgaagctccaggagagcggccccggtctcgttgcccccagtcaaagcctctctgtaacgtgcacagtgagtggtgtatcattgcctgattatggcgtctcctggataaggcagcccccgcgaaagggtcttgaatggcttggggtaatatggggctcagagacaacgtattataactccgctctcaaaagtcgcttgacgataataaaagataactccaagagtcaagttttccttaaaatgaacagtttgcagactgacgataccgctatatattattgtgctaaacattattactacggcggtagttacgcgatggattattgggggcaggggacttctgtcacagtcagtagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagaggaagcggagctactaacttcagcctgctgaagcaggctggagacgtggaggagaaccctggacctatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaataataaaataaaatcgctatccatcgaagatggatgtgtgttggttttttgtgtgactgtggggtggaggggacagataaaagtacccagaaccagagccacattaaccggccctgggaatataaggtggtcccagctcggggacacaggatccctggaggcagcaaacatgctgtcctgaagtggacataggggcccgggttggaggaagaagactagctgagctctcggacccctggaagatgccatgacagggggctggaagagctagcacagactagagaggtaaggggggtaggggagctgcccaaatgaaaggagtgagaggtgacccgaatccacaggagaacggggtgtccaggcaaagaaagcaagaggatggagaggtggctaaagccagggagacggggtactttggggttgtccagaaaaacggtgatgatgcaggcctacaagaaggggaggcgggacgcaagggagacatccgtcggagaaggccatcctaagaaacgagagatggcacaggccccagaaggagaaggaaaagggaacccagcgagtgaagacggcatggggttgggtgagggaggagagatgcccggagaggacccagacacggggaggatccgctcagaggacatcacgtggtgcagcgccgagaaggaagtgctccggaaagagcatccttgggcagcaacacagcagagagcaaggggaagagggagtggaggaagacggaacctgaaggaggcggc

SEQ ID NO: 1388 - DNA, 4542 bp, Artificial Sequence
  Synthetic polynucleotide
gaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatgcttcttttggttacgtctctgttgctttgcgaacttcctcatccagcgttcttgctgatccccgatattcagatgactcagaccaccagtagcttgtctgcctcactgggagaccgagtaacaatctcctgcagggcaagtcaagacattagcaaatacctcaattggtaccagcagaagcccgacggaacggtaaaactcctcatctatcatacgtcaaggttgcattccggagtaccgtcacgattttcaggttctgggagcggaactgactattccttgactatttcaaacctcgagcaggaggacattgcgacatatttttgtcaacaaggtaataccctcccttacactttcggaggaggaaccaaactcgaaattaccgggtccaccagtggctctgggaagcctggcagtggagaaggttccactaaaggcgaggtgaagctccaggagagcggccccggtctcgttgcccccagtcaaagcctctctgtaacgtgcacagtgagtggtgtatcattgcctgattatggcgtctcctggataaggcagcccccgcgaaagggtcttgaatggcttggggtaatatggggctcagagacaacgtattataactccgctctcaaaagtcgcttgacgataataaaagataactccaagagtcaagttttccttaaaatgaacagtttgcagactgacgataccgctatatattattgtgctaaacattattactacggcggtagttacgcgatggattattgggggcaggggacttctgtcacagtcagtagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagaggaagcggagctactaacttcagcctgctgaagcaggctggagacgtggaggagaaccctggacctatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaataataaaataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaaccc

SEQ ID NO: 1389 - DNA, 3759 bp, Artificial Sequence
  Synthetic polynucleotide
ttttgtaaagaatataggtaaaaagtggcattttttctttggatttaattcttatggatttaagtcaacatgtattttcaagccaacaagttttgttaataagatggctgcaccctgctgctccatgccagatccaccacacagaaagcaaatgttcagtgcatctccctcttcctgtcagagcttatagaggaaggaagaccccgcaatgtggaggcatattgtattacaattacttttaatggcaaaaactgcagttacttttgtgccaacctactacatggtctggacagctaaatgtcatgtatttttcatggcccctccaggtattgtcagagtcctcttgtttggccttctaggaaggctgtgggacccagctttcttcaaccagtccaggtggaggcctctgccttgaacgtttccaagtgaggtaaaacccgcaggcccagaggcctctctacttcctgtgtggggttcagaaaccctcctcccctcccagcctcaggtgcctgcttcagaaaatggtgagtctctctcttataaagccctcctttttcatcctagcattgggaacaatggccccagggtccttatctctagcagatgttttgaaaaagtcatctgttttgctttttttccagaagtagtaagtctgctggcctccgccatcttagtaaagtaacagtcccatgaaacaaagatgcttcttttggttacgtctctgttgctttgcgaacttcctcatccagcgttcttgctgatccccgatattcagatgactcagaccaccagtagcttgtctgcctcactgggagaccgagtaacaatctcctgcagggcaagtcaagacattagcaaatacctcaattggtaccagcagaagcccgacggaacggtaaaactcctcatctatcatacgtcaaggttgcattccggagtaccgtcacgattttcaggttctgggagcggaactgactattccttgactatttcaaacctcgagcaggaggacattgcgacatatttttgtcaacaaggtaataccctcccttacactttcggaggaggaaccaaactcgaaattaccgggtccaccagtggctctgggaagcctggcagtggagaaggttccactaaaggcgaggtgaagctccaggagagcggccccggtctcgttgcccccagtcaaagcctctctgtaacgtgcacagtgagtggtgtatcattgcctgattatggcgtctcctggataaggcagcccccgcgaaagggtcttgaatggcttggggtaatatggggctcagagacaacgtattataactccgctctcaaaagtcgcttgacgataataaaagataactccaagagtcaagttttccttaaaatgaacagtttgcagactgacgataccgctatatattattgtgctaaacattattactacggcggtagttacgcgatggattattgggggcaggggacttctgtcacagtcagtagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagaggaagcggagctactaacttcagcctgctgaagcaggctggagacgtggaggagaaccctggacctatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaataataaaataaaatcgctatccatcgaagatggatgtgtgttggttttttgtgtggtgagtaggatggagtggaaagggtggtgtgtctccagaccgctggaaggcttacagccttacctggcactgcctagtggcaccaaggagcctcatttaccagatgtaaggaactgtttgtgctatgttagggtgagggattagagctggggactaaagaaaaagataggccacgggtgcctgggagagcgttcggggagcaggcaaagaagagcagttggggtgatcatagctattgtgagcagagaggtctcgctacctctaagtacgagctcattccaacttacccagccctccagaactaacccaaaagagactggaagagcgaagctccactccttgttttgaagagaccagatacttgcgtccaaactctgcacagggcatatatagcaattcactatctttgagaccataaaacgcctcgtaatttttagtccttttcaagtgaccaacaactttcagtttatttcatttttttgaagcaagatggattatgaattgataaataaccaagagcatttctgtatctcatatgagataaataataccaaaaaaagttgccatttattgtcagatactgtgtaaagaaaaaattatttagacgtgttaactggtttaatcctacttctgcctaggaaggaaggtgttatatcctctttttaaaattctttttaattttgactatataaactgataa

SEQ ID NO: 1390 - DNA, 4358 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatgcttcttttggttacgtctctgttgctttgcgaacttcctcatccagcgttcttgctgatccccgatattcagatgactcagaccaccagtagcttgtctgcctcactgggagaccgagtaacaatctcctgcagggcaagtcaagacattagcaaatacctcaattggtaccagcagaagcccgacggaacggtaaaactcctcatctatcatacgtcaaggttgcattccggagtaccgtcacgattttcaggttctgggagcggaactgactattccttgactatttcaaacctcgagcaggaggacattgcgacatatttttgtcaacaaggtaataccctcccttacactttcggaggaggaaccaaactcgaaattaccgggtccaccagtggctctgggaagcctggcagtggagaaggttccactaaaggcgaggtgaagctccaggagagcggccccggtctcgttgcccccagtcaaagcctctctgtaacgtgcacagtgagtggtgtatcattgcctgattatggcgtctcctggataaggcagcccccgcgaaagggtcttgaatggcttggggtaatatggggctcagagacaacgtattataactccgctctcaaaagtcgcttgacgataataaaagataactccaagagtcaagttttccttaaaatgaacagtttgcagactgacgataccgctatatattattgtgctaaacattattactacggcggtagttacgcgatggattattgggggcaggggacttctgtcacagtcagtagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1391 - DNA, 4236 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatcggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatgcttcttttggttacgtctctgttgctttgcgaacttcctcatccagcgttcttgctgatccccgatattcagatgactcagaccaccagtagcttgtctgcctcactgggagaccgagtaacaatctcctgcagggcaagtcaagacattagcaaatacctcaattggtaccagcagaagcccgacggaacggtaaaactcctcatctatcatacgtcaaggttgcattccggagtaccgtcacgattttcaggttctgggagcggaactgactattccttgactatttcaaacctcgagcaggaggacattgcgacatatttttgtcaacaaggtaataccctcccttacactttcggaggaggaaccaaactcgaaattaccgggtccaccagtggctctgggaagcctggcagtggagaaggttccactaaaggcgaggtgaagctccaggagagcggccccggtctcgttgcccccagtcaaagcctctctgtaacgtgcacagtgagtggtgtatcattgcctgattatggcgtctcctggataaggcagcccccgcgaaagggtcttgaatggcttggggtaatatggggctcagagacaacgtattataactccgctctcaaaagtcgcttgacgataataaaagataactccaagagtcaagttttccttaaaatgaacagtttgcagactgacgataccgctatatattattgtgctaaacattattactacggcggtagttacgcgatggattattgggggcaggggacttctgtcacagtcagtagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1392 - DNA, 3636 bp, Artificial Sequence
  Synthetic polynucleotide
taatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatcggaagcggagctactaacttcagcctgctgaagcaggctggagacgtggaggagaaccctggacccatgcttcttttggttacgtctctgttgctttgcgaacttcctcatccagcgttcttgctgatccccgatattcagatgactcagaccaccagtagcttgtctgcctcactgggagaccgagtaacaatctcctgcagggcaagtcaagacattagcaaatacctcaattggtaccagcagaagcccgacggaacggtaaaactcctcatctatcatacgtcaaggttgcattccggagtaccgtcacgattttcaggttctgggagcggaactgactattccttgactatttcaaacctcgagcaggaggacattgcgacatatttttgtcaacaaggtaataccctcccttacactttcggaggaggaaccaaactcgaaattaccgggtccaccagtggctctgggaagcctggcagtggagaaggttccactaaaggcgaggtgaagctccaggagagcggccccggtctcgttgcccccagtcaaagcctctctgtaacgtgcacagtgagtggtgtatcattgcctgattatggcgtctcctggataaggcagcccccgcgaaagggtcttgaatggcttggggtaatatggggctcagagacaacgtattataactccgctctcaaaagtcgcttgacgataataaaagataactccaagagtcaagttttccttaaaatgaacagtttgcagactgacgataccgctatatattattgtgctaaacattattactacggcggtagttacgcgatggattattgggggcaggggacttctgtcacagtcagtagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggagaagagcagcaggcatgagttgaatgaaggaggcagggccgggtcacaggg

SEQ ID NO: 1393 - DNA, 4419 bp, Artificial Sequence
  Synthetic polynucleotide
taatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatcggaagcggagctactaacttcagcctgctgaagcaggctggagacgtggaggagaaccctggacccatgcttcttttggttacgtctctgttgctttgcgaacttcctcatccagcgttcttgctgatccccgatattcagatgactcagaccaccagtagcttgtctgcctcactgggagaccgagtaacaatctcctgcagggcaagtcaagacattagcaaatacctcaattggtaccagcagaagcccgacggaacggtaaaactcctcatctatcatacgtcaaggttgcattccggagtaccgtcacgattttcaggttctgggagcggaactgactattccttgactatttcaaacctcgagcaggaggacattgcgacatatttttgtcaacaaggtaataccctcccttacactttcggaggaggaaccaaactcgaaattaccgggtccaccagtggctctgggaagcctggcagtggagaaggttccactaaaggcgaggtgaagctccaggagagcggccccggtctcgttgcccccagtcaaagcctctctgtaacgtgcacagtgagtggtgtatcattgcctgattatggcgtctcctggataaggcagcccccgcgaaagggtcttgaatggcttggggtaatatggggctcagagacaacgtattataactccgctctcaaaagtcgcttgacgataataaaagataactccaagagtcaagttttccttaaaatgaacagtttgcagactgacgataccgctatatattattgtgctaaacattattactacggcggtagttacgcgatggattattgggggcaggggacttctgtcacagtcagtagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagaggaagcggagctactaacttcagcctgctgaagcaggctggagacgtggaggagaaccctggacctatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaataataaaatcgctatccatcgaagatggatgtgtgttggttttttgtgtgccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggagaagagcagcaggcatgagttgaatgaaggaggcagggccgggtcacaggg

SEQ ID NO: 1394 - DNA, 4358 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggatatagttatgacccaatcacccgatagtcttgcggtaagcctgggggagcgagcaacaataaactgtcgggcatcaaaatccgtcagtacaagcgggtattcattcatgcactggtatcaacagaaacccggtcagccacccaagctcctgatttatcttgcgtctaatcttgagtccggcgtcccagaccggttttccggctccgggagcggcacggattttactcttactatttctagccttcaggccgaagatgtggcggtatactactgccagcattcaagggaagttccttggacgttcggtcagggcacgaaagtggaaattaaaggcggggggggatccggcgggggagggtctggaggaggtggcagtggtcaggtccaactggtgcagtccggggcagaggtaaaaaaacccggcgcgtctgttaaggtttcatgcaaggccagtggatatactttcaccaattacggaatgaactgggtgaggcaggcccctggtcaaggcctgaaatggatgggatggataaacacgtacaccggtgaacctacctatgccgatgcctttaagggtcgggttacgatgacgagagacacctccatatcaacagcctacatggagctcagcagattgaggagtgacgatacggcagtctattactgtgcaagagactacggcgattatggcatggattactggggccagggcactacagtaaccgtttccagcagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1395 - DNA, 4358 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtccagttggtgcaaagcggggcggaggtgaaaaaacccggcgcttccgtgaaggtgtcctgtaaggcgtccggttatacgttcacgaactacgggatgaattgggttcgccaagcgccggggcagggactgaaatggatggggtggataaatacctacaccggcgaacctacatacgccgacgcttttaaagggcgagtcactatgacgcgcgataccagcatatccaccgcatacatggagctgtcccgactccggtcagacgacacggctgtctactattgtgctcgggactatggcgattatggcatggactactggggtcagggtacgactgtaacagttagtagtggtggaggcggcagtggcggggggggaagcggaggagggggttctggtgacatagttatgacccaatccccagatagtttggcggtttctctgggcgagagggcaacgattaattgtcgcgcatcaaagagcgtttcaacgagcggatattcttttatgcattggtaccagcaaaaacccggacaaccgccgaagctgctgatctacttggcttcaaatcttgagtctggggtgccggaccgattttctggtagtggaagcggaactgactttacgctcacgatcagttcactgcaggctgaggatgtagcggtctattattgccagcacagtagagaagtcccctggaccttcggtcaaggcacgaaagtagaaattaaaagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1396 - DNA, 4364 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtccagttggtgcaaagcggggcggaggtgaaaaaacccggcgcttccgtgaaggtgtcctgtaaggcgtccggttatacgttcacgaactacgggatgaattgggttcgccaagcgccggggcagggactgaaatggatggggtggataaatacctacaccggcgaacctacatacgccgacgcttttaaagggcgagtcactatgacgcgcgataccagcatatccaccgcatacatggagctgtcccgactccggtcagacgacacggctgtctactattgtgctcgggactatggcgattatggcatggactactggggtcagggtacgactgtaacagttagtagtggtggaggcggcagtggcggggggggaagcggaggagggggttctggtgacatagttatgacccaatccccagatagtttggcggtttctctgggcgagagggcaacgattaattgtcgcgcatcaaagagcgtttcaacgagcggatattcttttatgcattggtaccagcaaaaacccggacaaccgccgaagctgctgatctacttggcttcaaatcttgagtctggggtgccggaccgattttctggtagtggaagcggaactgactttacgctcacgatcagttcactgcaggctgaggatgtagcggtctattattgccagcacagtagagaagtcccctggaccttcggtcaaggcacgaaagtagaaattaaaagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgcaaacggggcagaaagaaactcctgtatatattcaaacaaccatttatgagaccagtacaaactactcaagaggaagatggctgtagctgccgatttccagaagaagaagaaggaggatgtgaactgcgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1397 - DNA, 4536 bp, Artificial Sequence
  Synthetic polynucleotide
gaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggctcttcctgtaaccgcacttctgcttcctcttgctctgctgcttcatgctgctagacctcaggtgcagttacaacagtcaggaggaggattagtgcagccaggaggatctctgaaactgtcttgtgccgccagcggaatcgattttagcaggtactggatgtcttgggtgagaagagcccctggaaaaggactggagtggatcggcgagattaatcctgatagcagcaccatcaactatgcccctagcctgaaggacaagttcatcatcagccgggacaatgccaagaacaccctgtacctgcaaatgagcaaggtgaggagcgaggatacagctctgtactactgtgccagcctgtactacgattacggagatgctatggactattggggccagggaacaagcgttacagtgtcttctggaggaggaggatccggtggtggtggttcaggaggtggaggttcgggagatattgtgatgacacaaagccagcggttcatgaccacatctgtgggcgacagagtgagcgtgacctgtaaagcttctcagtctgtggacagcaatgttgcctggtatcagcagaagcccagacagagccctaaagccctgatcttttctgccagcctgagattttctggcgttcctgccagatttaccggctctggctctggcaccgattttacactgaccatcagcaatctgcagtctgaggatctggccgagtacttttgccagcagtacaacaactaccccctgacctttggagctggcacaaaactggagctgaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagaggaagcggagctactaacttcagcctgctgaagcaggctggagacgtggaggagaaccctggacctatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaataataaaataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaaccc

SEQ ID NO: 1398 - DNA, 4350 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggctcttcctgtaaccgcacttctgcttcctcttgctctgctgcttcatgctgctagacctcaggtgcagttacaacagtcaggaggaggattagtgcagccaggaggatctctgaaactgtcttgtgccgccagcggaatcgattttagcaggtactggatgtcttgggtgagaagagcccctggaaaaggactggagtggatcggcgagattaatcctgatagcagcaccatcaactatgcccctagcctgaaggacaagttcatcatcagccgggacaatgccaagaacaccctgtacctgcaaatgagcaaggtgaggagcgaggatacagctctgtactactgtgccagcctgtactacgattacggagatgctatggactattggggccagggaacaagcgttacagtgtcttctggaggaggaggatccggtggtggtggttcaggaggtggaggttcgggagatattgtgatgacacaaagccagcggttcatgaccacatctgtgggcgacagagtgagcgtgacctgtaaagcttctcagtctgtggacagcaatgttgcctggtatcagcagaagcccagacagagccctaaagccctgatcttttctgccagcctgagattttctggcgttcctgccagatttaccggctctggctctggcaccgattttacactgaccatcagcaatctgcagtctgaggatctggccgagtacttttgccagcagtacaacaactaccccctgacctttggagctggcacaaaactggagctgaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaa

SEQ ID NO: 1399 - DNA, 4536 bp, Artificial Sequence
  Synthetic polynucleotide
gaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggctcttcctgtaaccgcacttctgcttcctcttgctctgctgcttcatgctgctagacctgacatcgtgatgacccaaagccagaggttcatgaccacatctgtgggcgatagagtgagcgtgacctgtaaagcctctcagtctgtggacagcaatgttgcctggtatcagcagaagcctagacagagccctaaagccctgatctttagcgccagcctgagatttagcggagttcctgccagatttaccggaagcggatctggaaccgattttacactgaccatcagcaacctgcagagcgaggatctggccgagtacttttgccagcagtacaacaattaccctctgacctttggagccggcacaaagctggagctgaaaggaggaggaggatctggtggtggtggttcaggaggtggaggttcgggacaagttcaattacagcaatctggaggaggactggttcagcctggaggaagcctgaagctgtcttgtgccgcttctggaatcgattttagcagatactggatgagctgggtgagaagagcccctggcaaaggactggagtggattggcgagattaatcctgatagcagcaccatcaactatgcccctagcctgaaggacaagttcatcatcagccgggacaatgccaagaacaccctgtacctgcaaatgagcaaggtgaggagcgaggatacagctctgtactactgtgccagcctgtactacgattacggagatgctatggactattggggccagggaacaagcgttacagtgagcagcagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagaggaagcggagctactaacttcagcctgctgaagcaggctggagacgtggaggagaaccctggacctatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaataataaaataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaaccc

SEQ ID NO: 1400 - DNA, 4350 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggctcttcctgtaaccgcacttctgcttcctcttgctctgctgcttcatgctgctagacctgacatcgtgatgacccaaagccagaggttcatgaccacatctgtgggcgatagagtgagcgtgacctgtaaagcctctcagtctgtggacagcaatgttgcctggtatcagcagaagcctagacagagccctaaagccctgatctttagcgccagcctgagatttagcggagttcctgccagatttaccggaagcggatctggaaccgattttacactgaccatcagcaacctgcagagcgaggatctggccgagtacttttgccagcagtacaacaattaccctctgacctttggagccggcacaaagctggagctgaaaggaggaggaggatctggtggtggtggttcaggaggtggaggttcgggacaagttcaattacagcaatctggaggaggactggttcagcctggaggaagcctgaagctgtcttgtgccgcttctggaatcgattttagcagatactggatgagctgggtgagaagagcccctggcaaaggactggagtggattggcgagattaatcctgatagcagcaccatcaactatgcccctagcctgaaggacaagttcatcatcagccgggacaatgccaagaacaccctgtacctgcaaatgagcaaggtgaggagcgaggatacagctctgtactactgtgccagcctgtactacgattacggagatgctatggactattggggccagggaacaagcgttacagtgagcagcagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaa

SEQ ID NO: 1401 - DNA, 4349 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggaggtccagctggtggagagcggcggaggactggtccagcctggcggctccctgaaactgagctgcgccgccagcggcatcgacttcagcaggtactggatgagctgggtgagacaggcccctggcaagggcctggaatggatcggcgagatcaaccccgactccagcaccatcaactacgccgacagcgtcaagggcaggttcaccattagcagggacaatgccaagaacaccctgtacctgcagatgaacctgagcagggccgaagacaccgccctgtactactgtgccagcctgtactacgactatggcgacgctatggactactggggccagggcaccctggtgacagtgagctccggaggaggcggcagcggcggaggcggcagcggcggaggcggcagcgacatccagatgacccagagccctagcagcctgagcgcctccgtgggagatagggtgacaatcacctgtagggccagccagagcgtggactccaacgtggcctggtatcaacagaagcccgagaaggcccccaagagcctgatcttttccgcctccctgaggttcagcggagtccccagcaggttctccggatccggctccggaaccgactttaccctgaccatctccagcctgcagcccgaggacttcgccacctactactgccagcagtacaacagctaccccctgaccttcggcgccggcacaaagctggagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1402 - DNA, 4355 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggaggtccagctggtggagagcggcggaggactggtccagcctggcggctccctgaaactgagctgcgccgccagcggcatcgacttcagcaggtactggatgagctgggtgagacaggcccctggcaagggcctggaatggatcggcgagatcaaccccgactccagcaccatcaactacgccgacagcgtcaagggcaggttcaccattagcagggacaatgccaagaacaccctgtacctgcagatgaacctgagcagggccgaagacaccgccctgtactactgtgccagcctgtactacgactatggcgacgctatggactactggggccagggcaccctggtgacagtgagctccggaggaggcggcagcggcggaggcggcagcggcggaggcggcagcgacatccagatgacccagagccctagcagcctgagcgcctccgtgggagatagggtgacaatcacctgtagggccagccagagcgtggactccaacgtggcctggtatcaacagaagcccgagaaggcccccaagagcctgatcttttccgcctccctgaggttcagcggagtccccagcaggttctccggatccggctccggaaccgactttaccctgaccatctccagcctgcagcccgaggacttcgccacctactactgccagcagtacaacagctaccccctgaccttcggcgccggcacaaagctggagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgcaaacggggcagaaagaaactcctgtatatattcaaacaaccatttatgagaccagtacaaactactcaagaggaagatggctgtagctgccgatttccagaagaagaagaaggaggatgtgaactgcgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1403 - DNA, 4349 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggaggtgcagctggtggagagcggaggaggactggtgcagcccggaggctccctgaagctgagctgcgctgcctccggcatcgacttcagcaggtactggatgagctgggtgaggcaggctcccggcaaaggcctggagtggatcggcgagatcaaccccgacagcagcaccatcaactacgccgacagcgtgaagggcaggttcaccatcagcagggacaacgccaagaataccctgtacctgcagatgaacctgagcagggccgaggacacagccctgtactactgtgccagcctgtactacgactatggagacgctatggactactggggccagggaaccctggtgaccgtgagcagcggaggcggaggctccggcggcggaggcagcggaggaggcggcagcgatatccagatgacccagtcccccagctccctgagcgctagccctggcgacagggtgagcgtgacatgcaaggccagccagagcgtggacagcaacgtggcctggtaccagcagaaacccagacaggcccccaaggccctgatcttcagcgccagcctgaggtttagcggcgtgcccgctaggtttaccggatccggcagcggcaccgacttcaccctgaccatctccaacctgcagtccgaggacttcgccacctactactgccagcagtacaacaactaccccctgacattcggcgccggaaccaagctggagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1404 - DNA, 4349 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggacatccagatgacccagagccctagcagcctgagcgctagcgtgggcgacagggtgaccatcacctgcagggccagccagagcgtggactccaacgtggcctggtaccagcagaagcccgagaaggcccccaagagcctgatcttcagcgccagcctgaggttctccggagtgcctagcagatttagcggcagcggcagcggcacagacttcaccctgaccatcagcagcctccagcccgaggatttcgccacctactactgccagcagtacaactcctaccccctgaccttcggcgccggcacaaagctggagatcaagggaggaggaggaagcggaggaggaggaagcggaggcggaggaagcgaggtgcagctggtggagtccggaggaggcctggtgcaacctggaggcagcctgaagctgagctgtgccgccagcggaatcgacttcagcaggtactggatgtcctgggtgagacaggcccctggcaagggcctggagtggatcggagagatcaaccccgacagctccaccatcaactacgccgacagcgtgaagggcaggttcaccatcagcagagacaacgccaagaacaccctgtacctgcagatgaacctgtccagagccgaggacaccgccctgtactactgcgccagcctgtattacgactacggcgacgctatggactactggggccagggcaccctggtgacagtgagcagcagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1405 - DNA, 4349 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggacatccaaatgacccagtcccctagcagcctgtccgccagccctggagacagggtgtccgtgacctgcaaggccagccagtccgtggacagcaacgtcgcctggtatcagcagaagcccaggcaagctcccaaggctctgatcttctccgccagcctgagattttccggcgtgcccgccagattcaccggaagcggcagcggcaccgacttcaccctgaccatcagcaacctgcagagcgaggatttcgccacatactactgccagcagtacaacaactaccccctgaccttcggagccggcaccaagctggagatcaaaggcggcggaggcagcggcggcggcggcagcggcggaggcggatccgaagtgcagctggtggaaagcggaggcggactcgtgcagcctggcggaagcctgaagctgagctgtgccgccagcggcatcgacttcagcaggtactggatgagctgggtgaggcaggctcccggcaaaggcctggagtggatcggcgagatcaaccctgacagcagcaccatcaactacgccgacagcgtgaaaggcaggttcaccatcagcagggacaacgccaagaacaccctgtacctgcagatgaacctgtccagagccgaggacaccgccctgtactactgcgccagcctgtactacgactacggcgacgctatggactactggggccaaggcaccctcgtgaccgtcagctccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1406 - DNA, 4358 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggaggtgcagctgcagcagtccggccctgagctcgtgaagcctggagccagcgtgaaaatgagctgtaaggcctccggcaacaccctcaccaactacgtgatccattggatgaagcagatgcccggccagggcctggactggattggctacattctgccctacaacgacctgaccaagtacaacgagaagttcaccggcaaggccaccctgaccagcgataagagctccagcagcgcctacatggagctgaactccctgaccagcgaggacagcgccgtgtactactgcaccaggtgggactgggatggcttcttcgacccctggggacagggcaccaccctgacagtgtccagcggaggaggcggcagcggcggcggcggctccggcggcggcggcagcgatatcgtgatgacacagtcccctctgagcctgcctgtgagcctgggcgaccaggccagcatcagctgcaggtccacccagtccctggtgcactccaacggcaacacccacctgcactggtacctgcaaaggcccggccagtcccctaagctgctgatctacagcgtgagcaacaggtttagcgaggtgcccgatagattttccgccagcggcagcggcaccgacttcacactgaagatctccagggtggaggccgaggatctgggcgtgtacttctgcagccagaccagccacatcccctacaccttcggcggcggaaccaagctggagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1407 - DNA, 4358 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggacatcgtgatgacccagagccccctgagcctgcctgtgtccctgggagaccaggcttccatcagctgcaggtccacccagagcctggtgcactccaacggcaacacccacctgcactggtacctgcagaggcctggccagtcccccaagctgctgatctacagcgtgagcaataggttcagcgaggtgcccgacagattcagcgccagcggaagcggcaccgacttcaccctgaagatcagcagggtcgaggccgaagatctgggcgtgtacttctgctcccagacatcccacatcccttacaccttcggcggcggcaccaagctggagattaagggcggcggaggatccggcggaggaggatccggaggaggaggaagcgaggtgcagctgcagcagagcggacccgagctggtgaaacccggagccagcgtcaaaatgagctgcaaggccagcggcaacaccctgaccaactacgtcatccactggatgaagcagatgcccggacagggcctggactggatcggctacatcctgccctacaacgacctgaccaagtacaacgagaaattcaccggcaaggccaccctgaccagcgacaagagcagcagcagcgcctacatggagctgaacagcctgaccagcgaggactccgccgtgtactattgcaccaggtgggactgggacggcttctttgacccctggggccagggcacaacactcaccgtgagctccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1408 - DNA, 4358 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtgcagctggtgcagagcggagccgagctcaagaagcccggagcctccgtgaaggtgagctgcaaggccagcggcaacaccctgaccaactacgtgatccactgggtgagacaagcccccggccaaaggctggagtggatgggctacatcctgccctacaacgacctgaccaagtacagccagaagttccagggcagggtgaccatcaccagggataagagcgcctccaccgcctatatggagctgagcagcctgaggagcgaggacaccgctgtgtactactgtacaaggtgggactgggacggcttctttgacccctggggccagggcacaacagtgaccgtcagcagcggcggcggaggcagcggcggcggcggcagcggcggaggcggaagcgaaatcgtgatgacccagagccccgccacactgagcgtgagccctggcgagagggccagcatctcctgcagggctagccaaagcctggtgcacagcaacggcaacacccacctgcactggtaccagcagagacccggacaggctcccaggctgctgatctacagcgtgagcaacaggttctccgaggtgcctgccaggtttagcggcagcggaagcggcaccgactttaccctgaccatcagcagcgtggagtccgaggacttcgccgtgtattactgcagccagaccagccacatcccttacaccttcggcggcggcaccaagctggagatcaaaagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1409 - DNA, 4364 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtgcagctggtgcagagcggagccgagctcaagaagcccggagcctccgtgaaggtgagctgcaaggccagcggcaacaccctgaccaactacgtgatccactgggtgagacaagcccccggccaaaggctggagtggatgggctacatcctgccctacaacgacctgaccaagtacagccagaagttccagggcagggtgaccatcaccagggataagagcgcctccaccgcctatatggagctgagcagcctgaggagcgaggacaccgctgtgtactactgtacaaggtgggactgggacggcttctttgacccctggggccagggcacaacagtgaccgtcagcagcggcggcggaggcagcggcggcggcggcagcggcggaggcggaagcgaaatcgtgatgacccagagccccgccacactgagcgtgagccctggcgagagggccagcatctcctgcagggctagccaaagcctggtgcacagcaacggcaacacccacctgcactggtaccagcagagacccggacaggctcccaggctgctgatctacagcgtgagcaacaggttctccgaggtgcctgccaggtttagcggcagcggaagcggcaccgactttaccctgaccatcagcagcgtggagtccgaggacttcgccgtgtattactgcagccagaccagccacatcccttacaccttcggcggcggcaccaagctggagatcaaaagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgcaaacggggcagaaagaaactcctgtatatattcaaacaaccatttatgagaccagtacaaactactcaagaggaagatggctgtagctgccgatttccagaagaagaagaaggaggatgtgaactgcgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1410 - DNA, 4358 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtgcagctggtgcagagcggcgccgagctgaagaaacctggcgccagcgtcaaggtgagctgcaaggcttccggaaacaccctcaccaactacgtgatccactgggtgaggcaggcccccggacagagactggagtggatgggctacattctgccctacaacgacctgaccaagtacagccagaagttccagggcagggtcaccatcaccagggacaagagcgccagcaccgcctacatggagctgagcagcctgaggtccgaggacacagccgtgtactactgcaccaggtgggactgggacggattcttcgacccttggggccaaggcaccacagtgacagtgagctccggcggaggcggcagcggcggcggaggaagcggcggcggcggaagcgacatcgtgatgacccagagccctctgagcctgcccgtgacactgggacagcctgccacactgtcctgcaggagcacccagagcctggtgcatagcaacggcaacacccacctgcactggttccagcagagacctggccagagccccctgagactgatctacagcgtgagcaacagggacagcggcgtgcccgatagatttagcggcagcggcagcggcaccgactttaccctgaaaatctccagggtggaggccgaggatgtgggcgtgtattactgctcccagacaagccacattccctatacattcggcggcggcaccaagctggagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1411 - DNA, 4358 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggaaatcgtgatgacccagagccctgccacactgagcgtgagccctggcgagagagccagcatcagctgcagggcctcccagagcctggtgcactccaacggcaatacccacctgcactggtatcagcagagacccggccaggcccctaggctgctgatctactccgtgagcaacaggttctccgaggtgcccgccagattcagcggatccggcagcggcaccgacttcaccctcaccatctccagcgtggagagcgaggacttcgccgtctactactgcagccagacaagccacatcccctacaccttcggcggcggcaccaagctggagatcaagggcggcggcggcagcggcggcggaggcagcggaggcggcggatcccaggtgcaactggtgcagagcggagccgagctgaagaagcccggagccagcgtgaaggtcagctgcaaggccagcggcaacaccctgacaaactacgtgatccactgggtgaggcaggcccctggccaaaggctcgagtggatgggctacatcctcccctacaacgacctgaccaagtactcccagaagttccagggcagggtgaccatcaccagggataagagcgccagcaccgcctacatggaactcagcagcctgaggagcgaggacaccgccgtgtactactgcaccaggtgggactgggatggcttcttcgacccttggggccagggcaccaccgtgacagtgagctccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1412 - DNA, 4358 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggacatcgtgatgacacaatcccccctcagcctgcctgtgacactgggccagcctgccaccctgagctgcaggagcacccagtccctggtgcactccaacggcaacacccacctgcactggttccagcagaggcctggacagagccccctgaggctgatctacagcgtgagcaacagggactccggcgtgcccgatagattcagcggcagcggctccggcaccgatttcaccctgaagatctccagagtggaagccgaggacgtgggcgtctactactgcagccagaccagccatatcccctacaccttcggcggcggcaccaagctggagatcaagggaggcggcggaagcggcggaggcggatccggaggcggaggctcccaagtgcagctggtgcagagcggcgctgagctgaagaagcccggagccagcgtgaaggtgagctgcaaggccagcggaaacaccctgaccaactacgtgatccactgggtgagacaggcccccggacagagactcgagtggatgggctacatcctgccctacaacgacctgaccaagtacagccagaagttccagggcagggtgacaatcaccagggacaagagcgccagcaccgcctacatggagctgagcagcctgagatccgaggacaccgccgtgtactactgcaccaggtgggactgggacggcttctttgacccctggggccagggaaccacagtgaccgtgtcctccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1413 - DNA, 4334 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggaggtgcagctgcagcagagcggccctgagctggtgaagcccggcgccagcgtgaagatcagctgcaagacctccggctatacctttaccgagtacaccatcaactgggtgaagcagagccacggcaagagcctggagtggatcggcgatatctaccccgacaactacaacatcaggtacaaccagaagttcaagggcaaggccaccctgaccgtggacaagtccagcagcaccgcctacatggagctgaggagcctgtccagcgaggactccgccatctactactgcgccaaccacgactttttcgtcttctggggacagggcaccctggtgacagtgtccgctggcggcggcggcagcggcggcggcggctccggaggcggcggcagcgacatccagatgacacaggccacaagctccctgtccgccagcctgggcgatagggtgaccatcaattgcaggacctcccaggacatcagcaaccacctgaactggtaccagcagaaacccgacggcaccgtgaagctgctcatctactacaccagcaggctgcagtccggcgtccctagcagattcagcggatccggcagcggcaccgactatagcctgaccatcagcaacctcgagcaggaggacatcggcacctacttctgccatcagggcaacaccctgccccctacctttggcggcggcacaaagctggagattaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1414 - DNA, 4334 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggatatccagatgacccaggccaccagcagcctgagcgcttccctcggcgacagggtgaccatcaactgcaggaccagccaggacatctccaaccacctgaactggtaccagcagaagcccgacggcaccgtgaaactgctgatctactacaccagcagactgcagagcggcgtgccctccagattttccggcagcggctccggcaccgactacagcctgaccattagcaacctggagcaggaggacatcggaacctacttctgccaccagggcaacacactgcctcccaccttcggcggcggcacaaagctcgagatcaagggcggcggcggaagcggcggcggcggcagcggcggcggaggctccgaggtgcaactgcaacagagcggacctgagctggtgaagcctggcgccagcgtgaagatctcctgtaagaccagcggctacaccttcaccgagtacaccatcaactgggtgaagcagagccacggcaagagcctcgaatggatcggcgacatctatcccgacaactacaatatcagatacaaccagaagttcaagggaaaggccaccctgaccgtggataagtcctcctccaccgcttacatggagctgaggagcctgagcagcgaggactccgccatctactactgcgccaaccacgacttcttcgtgttctggggccaaggcaccctcgtgaccgtgagcgccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1415 - DNA, 4334 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtgcagctggtgcagtccggcgctgagctgaagaagcccggcgccagcgtgaagatcagctgcaaggccagcggctacaccttcaccgaatacaccatcaactgggtgagacaggcccctggacagaggctcgagtggatgggcgacatctaccccgacaactacagcatcaggtacaaccagaagttccagggcagggtgacaatcaccagggacaccagcgccagcaccgcctatatggagctgagcagcctgagatccgaggacaccgccgtctattactgcgccaaccacgacttcttcgtgttctggggccagggaacactggtgaccgtgtccagcggcggcggcggcagcggcggcggaggaagcggcggcggcggcagcgatatccagatgacccagagcccctcctccctgagcgctagcgtgggcgacagggtgaccattacctgtcaggcctcccaggacatcagcaactacctgaactggtaccagcagaagcctggcaaggcccccaagctgctgatctattacaccagcaggctggagaccggcgtgccctccagattcagcggctccggctccggaaccgacttcaccttcaccatcagctccctgcagcctgaggacatcgccacctactactgccagcagggcaacaccctgcctcccacattcggcggcggcacaaaggtggagatcaaaagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1416 - DNA, 4334 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtgcagctggtccagtccggcgccgaactgaagaagcctggcgccagcgtgaagatcagctgcaaggcctccggctacaccttcaccgagtacaccatcaactgggtgaggcaagcccccggccagagactggagtggatgggcgacatctaccccgacaactacagcatcaggtacaaccagaagttccagggcagggtgacaatcaccagggataccagcgccagcacagcctatatggagctgtcctccctgagatccgaggacaccgccgtgtattactgcgccaaccacgacttcttcgtgttctggggccaaggcaccctggtgaccgtgagcagcggcggcggcggctccggcggcggaggctccggaggcggaggcagcgacatccagatgacccagagcccttccagcctgagcgctagcctgggcgacagggtgaccatcacctgcaggaccagccaggacatcagcaatcacctgaactggtaccagcaaaagcccggcaaggcccctaagctgctgatctactacaccagcaggctggaaagcggcgtgcctagcaggttcagcggcagcggctccggaaccgactacagcctgaccattagcagcctgcaacctgaggacatcggcacctattactgccagcagggcaacaccctgcctcctacctttggcggcggcaccaaactcgagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1417 - DNA, 4334 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtgcagctggtgcagagcggccctgagctgaagaagcccggagccagcgtgaagatctcctgcaagacctccggctacaccttcaccgagtacaccatcaactgggtgaagcaggcccccggacagggactggaatggatcggcgacatctaccccgacaactacaacatcaggtacaaccagaagttccaaggcaaggccaccatcacaagggacaccagcagcagcaccgcctacatggagctgagcagcctgaggagcgaggataccgccgtgtactactgcgccaaccacgacttcttcgtgttctggggccagggcaccctggtgacagtgagcagcggaggaggcggaagcggaggaggaggatccggaggaggaggcagcgacatccagatgacccagtccccctcctccctgagcgcctccgtgggagacagggtgaccatcacctgccaggccagccaggacatcagcaactacctgaactggtaccagcagaagcccggcaaggcccccaagctgctgatttactacaccagcaggctggaaaccggcgtgcccagcagatttagcggcagcggcagcggcaccgactttacctttaccatctccagcctgcagcccgaggatatcgccacatactactgccagcagggcaacaccctcccccctacctttggcggcggcaccaaggtggagattaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1418 - DNA, 4334 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtgcagctggtgcagtccggccccgaactgaaaaagcccggcgccagcgtcaagatcagctgcaagacctccggctacaccttcaccgagtacaccatcaactgggtgaagcaggcccccggccagggactggaatggattggcgacatctaccccgacaactacaacattaggtataaccagaagttccagggcaaggccaccatcacaagagacaccagcagcagcaccgcctacatggagctgagcagcctgaggagcgaggacaccgccgtgtactactgcgccaaccacgacttcttcgtgttctggggccagggaaccctggtgacagtgtccagcggcggcggcggctccggcggcggcggctccggcggcggcggcagcgacattcagatgacacagagcccctccagcctgagcgccagcctgggcgatagggtgaccatcacctgcagaaccagccaggacatcagcaaccacctgaattggtaccagcagaagcccggaaaggcccccaaactgctgatctactacaccagcaggctggagagcggcgtgcctagcaggtttagcggcagcggcagcggcacagattacagcctgaccatcagcagcctgcagcccgaagacatcggcacctactactgccagcagggcaacaccctgccccctacctttggcggaggcaccaagctggagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1419 - DNA, 4334 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggacatccagatgacacagagccctagcagcctgagcgcttccgtgggcgacagggtgaccatcacctgccaggccagccaggacatcagcaactacctcaactggtaccagcagaagcccggcaaggcccctaagctgctgatctactacacctccaggctggagaccggagtgccctccagattttccggcagcggcagcggcaccgatttcaccttcaccatcagcagcctgcagcccgaggacatcgccacctactattgccagcagggcaacaccctgccccccacatttggaggcggcaccaaggtggagatcaagggcggaggaggaagcggaggaggaggaagcggaggaggcggaagccaggtgcagctggtgcagagcggcgctgagctcaagaagcctggcgccagcgtgaagatcagctgcaaagcctccggatacaccttcaccgagtacaccatcaattgggtgagacaggcccccggccaaagactggagtggatgggcgacatctatcccgacaactacagcatcaggtacaaccagaagttccagggcagggtgacaatcaccagagacaccagcgccagcaccgcctacatggagctgagcagcctgaggagcgaggacaccgccgtgtactactgcgccaatcacgacttcttcgtgttctggggccagggaaccctggtgaccgtcagctccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1420 - DNA, 4334 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggatatccagatgacacagagccctagctccctgagcgccagcctgggcgatagggtgaccatcacctgcaggacctcccaggacatcagcaaccacctgaactggtaccagcagaagcccggcaaagcccccaagctgctgatctactacaccagcaggctggaaagcggcgtgcccagcaggtttagcggaagcggcagcggcaccgactacagcctgaccatcagctccctgcagcccgaggacatcggcacctactactgccagcagggcaacaccctgcctcccaccttcggaggcggaaccaagctggagattaagggaggcggcggaagcggcggcggcggctccggcggaggaggcagccaggtgcagctggtgcagtccggagccgagctgaaaaagcctggcgccagcgtgaagatcagctgcaaggccagcggctacaccttcaccgagtacaccatcaactgggtgaggcaggcccctggccagagactcgagtggatgggcgacatctaccccgacaactactccatcaggtacaaccagaagtttcagggcagggtgaccattaccagggacaccagcgccagcacagcctacatggagctgagcagcctgaggagcgaggatacagccgtctactactgcgccaaccacgactttttcgtgttctggggacagggcaccctggtgaccgtgtcctccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1421 - DNA, 4334 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggacatccaaatgacccagagccctagctccctgagcgcttccgtgggcgacagagtgaccattacctgccaggccagccaggacatcagcaactacctgaactggtatcagcagaagcctggcaaggcccccaagctgctgatctactacaccagcaggctggagaccggagtgcccagcaggtttagcggctccggatccggcaccgacttcaccttcaccatctccagcctgcagcccgaggacatcgccacctactactgccagcagggcaataccctcccccctaccttcggaggcggcaccaaggtggagatcaagggcggcggcggctccggcggcggcggcagcggcggaggcggcagccaggtgcaactggtgcagagcggccctgagctgaagaaacccggcgccagcgtgaaaatcagctgcaagaccagcggctacacattcaccgagtacaccatcaactgggtgaagcaggctcccggacagggactggagtggatcggcgacatctaccctgacaactacaacatcagatacaaccaaaagttccagggcaaggccaccatcaccagggacaccagctcctccaccgcctacatggagctgagcagcctgaggagcgaggacaccgctgtgtactactgcgccaaccacgacttcttcgtgttctggggccagggaaccctggtgaccgtgagcagcagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1422 - DNA, 4334 bp, Artificial Sequence
  Synthetic polynucleotide
gagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggatatccagatgacacaaagccccagcagcctgtccgctagcctgggcgatagggtgaccatcacatgcaggaccagccaggacatctccaaccacctgaactggtaccagcagaagcctggaaaggcccccaaactgctgatctactacaccagcaggctggagagcggcgtgcctagcaggttttccggcagcggcagcggcaccgactatagcctgaccatcagctccctgcagcccgaggacatcggcacctactactgccagcagggaaacacactgccccccacctttggcggcggcacaaagctggagatcaagggcggcggcggatccggcggcggaggcagcggaggaggaggaagccaggtgcagctggtgcagtccggccctgagctgaagaagcccggagccagcgtgaaaattagctgcaagacctccggctacacattcaccgagtacaccatcaactgggtgaagcaggctcccggccagggactggagtggatcggcgacatctaccccgacaactacaacatcaggtacaaccagaaattccagggcaaggccaccatcaccagggacaccagctcctccaccgcctatatggagctgtccagcctgagaagcgaggataccgccgtgtactactgcgccaaccacgatttcttcgtgttctggggccagggcacactggtcaccgtgagcagcagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1423 - DNA, 1518 bp, Artificial Sequence
  Synthetic polynucleotide
atggcgcttccggtgacagcactgctcctccccttggcgctgttgctccacgcagcaaggccggatatagttatgacccaatcacccgatagtcttgcggtaagcctgggggagcgagcaacaataaactgtcgggcatcaaaatccgtcagtacaagcgggtattcattcatgcactggtatcaacagaaacccggtcagccacccaagctcctgatttatcttgcgtctaatcttgagtccggcgtcccagaccggttttccggctccgggagcggcacggattttactcttactatttctagccttcaggccgaagatgtggcggtatactactgccagcattcaagggaagttccttggacgttcggtcagggcacgaaagtggaaattaaaggcggggggggatccggcgggggagggtctggaggaggtggcagtggtcaggtccaactggtgcagtccggggcagaggtaaaaaaacccggcgcgtctgttaaggtttcatgcaaggccagtggatatactttcaccaattacggaatgaactgggtgaggcaggcccctggtcaaggcctgaaatggatgggatggataaacacgtacaccggtgaacctacctatgccgatgcctttaagggtcgggttacgatgacgagagacacctccatatcaacagcctacatggagctcagcagattgaggagtgacgatacggcagtctattactgtgcaagagactacggcgattatggcatggattactggggccagggcactacagtaaccgtttccagcagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1424 - DNA, 1518 bp, Artificial Sequence
  Synthetic polynucleotide
atggcgcttccggtgacagcactgctcctccccttggcgctgttgctccacgcagcaaggccgcaggtccagttggtgcaaagcggggcggaggtgaaaaaacccggcgcttccgtgaaggtgtcctgtaaggcgtccggttatacgttcacgaactacgggatgaattgggttcgccaagcgccggggcagggactgaaatggatggggtggataaatacctacaccggcgaacctacatacgccgacgcttttaaagggcgagtcactatgacgcgcgataccagcatatccaccgcatacatggagctgtcccgactccggtcagacgacacggctgtctactattgtgctcgggactatggcgattatggcatggactactggggtcagggtacgactgtaacagttagtagtggtggaggcggcagtggcggggggggaagcggaggagggggttctggtgacatagttatgacccaatccccagatagtttggcggtttctctgggcgagagggcaacgattaattgtcgcgcatcaaagagcgtttcaacgagcggatattcttttatgcattggtaccagcaaaaacccggacaaccgccgaagctgctgatctacttggcttcaaatcttgagtctggggtgccggaccgattttctggtagtggaagcggaactgactttacgctcacgatcagttcactgcaggctgaggatgtagcggtctattattgccagcacagtagagaagtcccctggaccttcggtcaaggcacgaaagtagaaattaaaagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1425 - DNA, 1512 bp, Artificial Sequence
  Synthetic polynucleotide
atggctcttcctgtaaccgcacttctgcttcctcttgctctgctgcttcatgctgctagacctcaggtgcagttacaacagtcaggaggaggattagtgcagccaggaggatctctgaaactgtcttgtgccgccagcggaatcgattttagcaggtactggatgtcttgggtgagaagagcccctggaaaaggactggagtggatcggcgagattaatcctgatagcagcaccatcaactatgcccctagcctgaaggacaagttcatcatcagccgggacaatgccaagaacaccctgtacctgcaaatgagcaaggtgaggagcgaggatacagctctgtactactgtgccagcctgtactacgattacggagatgctatggactattggggccagggaacaagcgttacagtgtcttctggaggaggaggatccggtggtggtggttcaggaggtggaggttcgggagatattgtgatgacacaaagccagcggttcatgaccacatctgtgggcgacagagtgagcgtgacctgtaaagcttctcagtctgtggacagcaatgttgcctggtatcagcagaagcccagacagagccctaaagccctgatcttttctgccagcctgagattttctggcgttcctgccagatttaccggctctggctctggcaccgattttacactgaccatcagcaatctgcagtctgaggatctggccgagtacttttgccagcagtacaacaactaccccctgacctttggagctggcacaaaactggagctgaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1426 - DNA, 1512 bp, Artificial Sequence
  Synthetic polynucleotide
atggctcttcctgtaaccgcacttctgcttcctcttgctctgctgcttcatgctgctagacctgacatcgtgatgacccaaagccagaggttcatgaccacatctgtgggcgatagagtgagcgtgacctgtaaagcctctcagtctgtggacagcaatgttgcctggtatcagcagaagcctagacagagccctaaagccctgatctttagcgccagcctgagatttagcggagttcctgccagatttaccggaagcggatctggaaccgattttacactgaccatcagcaacctgcagagcgaggatctggccgagtacttttgccagcagtacaacaattaccctctgacctttggagccggcacaaagctggagctgaaaggaggaggaggatctggtggtggtggttcaggaggtggaggttcgggacaagttcaattacagcaatctggaggaggactggttcagcctggaggaagcctgaagctgtcttgtgccgcttctggaatcgattttagcagatactggatgagctgggtgagaagagcccctggcaaaggactggagtggattggcgagattaatcctgatagcagcaccatcaactatgcccctagcctgaaggacaagttcatcatcagccgggacaatgccaagaacaccctgtacctgcaaatgagcaaggtgaggagcgaggatacagctctgtactactgtgccagcctgtactacgattacggagatgctatggactattggggccagggaacaagcgttacagtgagcagcagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1427 - DNA, 1509 bp, Artificial Sequence
  Synthetic polynucleotide
atggcgcttccggtgacagcactgctcctccccttggcgctgttgctccacgcagcaaggccggaggtccagctggtggagagcggcggaggactggtccagcctggcggctccctgaaactgagctgcgccgccagcggcatcgacttcagcaggtactggatgagctgggtgagacaggcccctggcaagggcctggaatggatcggcgagatcaaccccgactccagcaccatcaactacgccgacagcgtcaagggcaggttcaccattagcagggacaatgccaagaacaccctgtacctgcagatgaacctgagcagggccgaagacaccgccctgtactactgtgccagcctgtactacgactatggcgacgctatggactactggggccagggcaccctggtgacagtgagctccggaggaggcggcagcggcggaggcggcagcggcggaggcggcagcgacatccagatgacccagagccctagcagcctgagcgcctccgtgggagatagggtgacaatcacctgtagggccagccagagcgtggactccaacgtggcctggtatcaacagaagcccgagaaggcccccaagagcctgatcttttccgcctccctgaggttcagcggagtccccagcaggttctccggatccggctccggaaccgactttaccctgaccatctccagcctgcagcccgaggacttcgccacctactactgccagcagtacaacagctaccccctgaccttcggcgccggcacaaagctggagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1428 - DNA, 1515 bp, Artificial Sequence
  Synthetic polynucleotide
atggcgcttccggtgacagcactgctcctccccttggcgctgttgctccacgcagcaaggccggaggtccagctggtggagagcggcggaggactggtccagcctggcggctccctgaaactgagctgcgccgccagcggcatcgacttcagcaggtactggatgagctgggtgagacaggcccctggcaagggcctggaatggatcggcgagatcaaccccgactccagcaccatcaactacgccgacagcgtcaagggcaggttcaccattagcagggacaatgccaagaacaccctgtacctgcagatgaacctgagcagggccgaagacaccgccctgtactactgtgccagcctgtactacgactatggcgacgctatggactactggggccagggcaccctggtgacagtgagctccggaggaggcggcagcggcggaggcggcagcggcggaggcggcagcgacatccagatgacccagagccctagcagcctgagcgcctccgtgggagatagggtgacaatcacctgtagggccagccagagcgtggactccaacgtggcctggtatcaacagaagcccgagaaggcccccaagagcctgatcttttccgcctccctgaggttcagcggagtccccagcaggttctccggatccggctccggaaccgactttaccctgaccatctccagcctgcagcccgaggacttcgccacctactactgccagcagtacaacagctaccccctgaccttcggcgccggcacaaagctggagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgcaaacggggcagaaagaaactcctgtatatattcaaacaaccatttatgagaccagtacaaactactcaagaggaagatggctgtagctgccgatttccagaagaagaagaaggaggatgtgaactgcgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1429 - DNA, 1509 bp, Artificial Sequence
  Synthetic polynucleotide
atggcgcttccggtgacagcactgctcctccccttggcgctgttgctccacgcagcaaggccggaggtgcagctggtggagagcggaggaggactggtgcagcccggaggctccctgaagctgagctgcgctgcctccggcatcgacttcagcaggtactggatgagctgggtgaggcaggctcccggcaaaggcctggagtggatcggcgagatcaaccccgacagcagcaccatcaactacgccgacagcgtgaagggcaggttcaccatcagcagggacaacgccaagaataccctgtacctgcagatgaacctgagcagggccgaggacacagccctgtactactgtgccagcctgtactacgactatggagacgctatggactactggggccagggaaccctggtgaccgtgagcagcggaggcggaggctccggcggcggaggcagcggaggaggcggcagcgatatccagatgacccagtcccccagctccctgagcgctagccctggcgacagggtgagcgtgacatgcaaggccagccagagcgtggacagcaacgtggcctggtaccagcagaaacccagacaggcccccaaggccctgatcttcagcgccagcctgaggtttagcggcgtgcccgctaggtttaccggatccggcagcggcaccgacttcaccctgaccatctccaacctgcagtccgaggacttcgccacctactactgccagcagtacaacaactaccccctgacattcggcgccggaaccaagctggagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1430 - DNA, 1509 bp, Artificial Sequence
  Synthetic polynucleotide
atggcgcttccggtgacagcactgctcctccccttggcgctgttgctccacgcagcaaggccggacatccagatgacccagagccctagcagcctgagcgctagcgtgggcgacagggtgaccatcacctgcagggccagccagagcgtggactccaacgtggcctggtaccagcagaagcccgagaaggcccccaagagcctgatcttcagcgccagcctgaggttctccggagtgcctagcagatttagcggcagcggcagcggcacagacttcaccctgaccatcagcagcctccagcccgaggatttcgccacctactactgccagcagtacaactcctaccccctgaccttcggcgccggcacaaagctggagatcaagggaggaggaggaagcggaggaggaggaagcggaggcggaggaagcgaggtgcagctggtggagtccggaggaggcctggtgcaacctggaggcagcctgaagctgagctgtgccgccagcggaatcgacttcagcaggtactggatgtcctgggtgagacaggcccctggcaagggcctggagtggatcggagagatcaaccccgacagctccaccatcaactacgccgacagcgtgaagggcaggttcaccatcagcagagacaacgccaagaacaccctgtacctgcagatgaacctgtccagagccgaggacaccgccctgtactactgcgccagcctgtattacgactacggcgacgctatggactactggggccagggcaccctggtgacagtgagcagcagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1431 - DNA, 1509 bp, Artificial Sequence
  Synthetic polynucleotide
atggcgcttccggtgacagcactgctcctccccttggcgctgttgctccacgcagcaaggccggacatccaaatgacccagtcccctagcagcctgtccgccagccctggagacagggtgtccgtgacctgcaaggccagccagtccgtggacagcaacgtcgcctggtatcagcagaagcccaggcaagctcccaaggctctgatcttctccgccagcctgagattttccggcgtgcccgccagattcaccggaagcggcagcggcaccgacttcaccctgaccatcagcaacctgcagagcgaggatttcgccacatactactgccagcagtacaacaactaccccctgaccttcggagccggcaccaagctggagatcaaaggcggcggaggcagcggcggcggcggcagcggcggaggcggatccgaagtgcagctggtggaaagcggaggcggactcgtgcagcctggcggaagcctgaagctgagctgtgccgccagcggcatcgacttcagcaggtactggatgagctgggtgaggcaggctcccggcaaaggcctggagtggatcggcgagatcaaccctgacagcagcaccatcaactacgccgacagcgtgaaaggcaggttcaccatcagcagggacaacgccaagaacaccctgtacctgcagatgaacctgtccagagccgaggacaccgccctgtactactgcgccagcctgtactacgactacggcgacgctatggactactggggccaaggcaccctcgtgaccgtcagctccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1432 - DNA, 1518 bp, Artificial Sequence
  Synthetic polynucleotide
atggcgcttccggtgacagcactgctcctccccttggcgctgttgctccacgcagcaaggccggaggtgcagctgcagcagtccggccctgagctcgtgaagcctggagccagcgtgaaaatgagctgtaaggcctccggcaacaccctcaccaactacgtgatccattggatgaagcagatgcccggccagggcctggactggattggctacattctgccctacaacgacctgaccaagtacaacgagaagttcaccggcaaggccaccctgaccagcgataagagctccagcagcgcctacatggagctgaactccctgaccagcgaggacagcgccgtgtactactgcaccaggtgggactgggatggcttcttcgacccctggggacagggcaccaccctgacagtgtccagcggaggaggcggcagcggcggcggcggctccggcggcggcggcagcgatatcgtgatgacacagtcccctctgagcctgcctgtgagcctgggcgaccaggccagcatcagctgcaggtccacccagtccctggtgcactccaacggcaacacccacctgcactggtacctgcaaaggcccggccagtcccctaagctgctgatctacagcgtgagcaacaggtttagcgaggtgcccgatagattttccgccagcggcagcggcaccgacttcacactgaagatctccagggtggaggccgaggatctgggcgtgtacttctgcagccagaccagccacatcccctacaccttcggcggcggaaccaagctggagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1433 - DNA, 1518 bp, Artificial Sequence
  Synthetic polynucleotide
atggcgcttccggtgacagcactgctcctccccttggcgctgttgctccacgcagcaaggccggacatcgtgatgacccagagccccctgagcctgcctgtgtccctgggagaccaggcttccatcagctgcaggtccacccagagcctggtgcactccaacggcaacacccacctgcactggtacctgcagaggcctggccagtcccccaagctgctgatctacagcgtgagcaataggttcagcgaggtgcccgacagattcagcgccagcggaagcggcaccgacttcaccctgaagatcagcagggtcgaggccgaagatctgggcgtgtacttctgctcccagacatcccacatcccttacaccttcggcggcggcaccaagctggagattaagggcggcggaggatccggcggaggaggatccggaggaggaggaagcgaggtgcagctgcagcagagcggacccgagctggtgaaacccggagccagcgtcaaaatgagctgcaaggccagcggcaacaccctgaccaactacgtcatccactggatgaagcagatgcccggacagggcctggactggatcggctacatcctgccctacaacgacctgaccaagtacaacgagaaattcaccggcaaggccaccctgaccagcgacaagagcagcagcagcgcctacatggagctgaacagcctgaccagcgaggactccgccgtgtactattgcaccaggtgggactgggacggcttctttgacccctggggccagggcacaacactcaccgtgagctccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1434 - DNA, 1518 bp, Artificial Sequence
  Synthetic polynucleotide
atggcgcttccggtgacagcactgctcctccccttggcgctgttgctccacgcagcaaggccgcaggtgcagctggtgcagagcggagccgagctcaagaagcccggagcctccgtgaaggtgagctgcaaggccagcggcaacaccctgaccaactacgtgatccactgggtgagacaagcccccggccaaaggctggagtggatgggctacatcctgccctacaacgacctgaccaagtacagccagaagttccagggcagggtgaccatcaccagggataagagcgcctccaccgcctatatggagctgagcagcctgaggagcgaggacaccgctgtgtactactgtacaaggtgggactgggacggcttctttgacccctggggccagggcacaacagtgaccgtcagcagcggcggcggaggcagcggcggcggcggcagcggcggaggcggaagcgaaatcgtgatgacccagagccccgccacactgagcgtgagccctggcgagagggccagcatctcctgcagggctagccaaagcctggtgcacagcaacggcaacacccacctgcactggtaccagcagagacccggacaggctcccaggctgctgatctacagcgtgagcaacaggttctccgaggtgcctgccaggtttagcggcagcggaagcggcaccgactttaccctgaccatcagcagcgtggagtccgaggacttcgccgtgtattactgcagccagaccagccacatcccttacaccttcggcggcggcaccaagctggagatcaaaagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1435 - DNA, 1524 bp, Artificial Sequence
  Synthetic polynucleotide
atggcgcttccggtgacagcactgctcctccccttggcgctgttgctccacgcagcaaggccgcaggtgcagctggtgcagagcggagccgagctcaagaagcccggagcctccgtgaaggtgagctgcaaggccagcggcaacaccctgaccaactacgtgatccactgggtgagacaagcccccggccaaaggctggagtggatgggctacatcctgccctacaacgacctgaccaagtacagccagaagttccagggcagggtgaccatcaccagggataagagcgcctccaccgcctatatggagctgagcagcctgaggagcgaggacaccgctgtgtactactgtacaaggtgggactgggacggcttctttgacccctggggccagggcacaacagtgaccgtcagcagcggcggcggaggcagcggcggcggcggcagcggcggaggcggaagcgaaatcgtgatgacccagagccccgccacactgagcgtgagccctggcgagagggccagcatctcctgcagggctagccaaagcctggtgcacagcaacggcaacacccacctgcactggtaccagcagagacccggacaggctcccaggctgctgatctacagcgtgagcaacaggttctccgaggtgcctgccaggtttagcggcagcggaagcggcaccgactttaccctgaccatcagcagcgtggagtccgaggacttcgccgtgtattactgcagccagaccagccacatcccttacaccttcggcggcggcaccaagctggagatcaaaagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgcaaacggggcagaaagaaactcctgtatatattcaaacaaccatttatgagaccagtacaaactactcaagaggaagatggctgtagctgccgatttccagaagaagaagaaggaggatgtgaactgcgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1436 - DNA, 1518 bp, Artificial Sequence
  Synthetic polynucleotide
atggcgcttccggtgacagcactgctcctccccttggcgctgttgctccacgcagcaaggccgcaggtgcagctggtgcagagcggcgccgagctgaagaaacctggcgccagcgtcaaggtgagctgcaaggcttccggaaacaccctcaccaactacgtgatccactgggtgaggcaggcccccggacagagactggagtggatgggctacattctgccctacaacgacctgaccaagtacagccagaagttccagggcagggtcaccatcaccagggacaagagcgccagcaccgcctacatggagctgagcagcctgaggtccgaggacacagccgtgtactactgcaccaggtgggactgggacggattcttcgacccttggggccaaggcaccacagtgacagtgagctccggcggaggcggcagcggcggcggaggaagcggcggcggcggaagcgacatcgtgatgacccagagccctctgagcctgcccgtgacactgggacagcctgccacactgtcctgcaggagcacccagagcctggtgcatagcaacggcaacacccacctgcactggttccagcagagacctggccagagccccctgagactgatctacagcgtgagcaacagggacagcggcgtgcccgatagatttagcggcagcggcagcggcaccgactttaccctgaaaatctccagggtggaggccgaggatgtgggcgtgtattactgctcccagacaagccacattccctatacattcggcggcggcaccaagctggagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1437 - DNA, 1518 bp, Artificial Sequence
  Synthetic polynucleotide
atggcgcttccggtgacagcactgctcctccccttggcgctgttgctccacgcagcaaggccggaaatcgtgatgacccagagccctgccacactgagcgtgagccctggcgagagagccagcatcagctgcagggcctcccagagcctggtgcactccaacggcaatacccacctgcactggtatcagcagagacccggccaggcccctaggctgctgatctactccgtgagcaacaggttctccgaggtgcccgccagattcagcggatccggcagcggcaccgacttcaccctcaccatctccagcgtggagagcgaggacttcgccgtctactactgcagccagacaagccacatcccctacaccttcggcggcggcaccaagctggagatcaagggcggcggcggcagcggcggcggaggcagcggaggcggcggatcccaggtgcaactggtgcagagcggagccgagctgaagaagcccggagccagcgtgaaggtcagctgcaaggccagcggcaacaccctgacaaactacgtgatccactgggtgaggcaggcccctggccaaaggctcgagtggatgggctacatcctcccctacaacgacctgaccaagtactcccagaagttccagggcagggtgaccatcaccagggataagagcgccagcaccgcctacatggaactcagcagcctgaggagcgaggacaccgccgtgtactactgcaccaggtgggactgggatggcttcttcgacccttggggccagggcaccaccgtgacagtgagctccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1438 - DNA, 1518 bp, Artificial Sequence
  Synthetic polynucleotide
atggcgcttccggtgacagcactgctcctccccttggcgctgttgctccacgcagcaaggccggacatcgtgatgacacaatcccccctcagcctgcctgtgacactgggccagcctgccaccctgagctgcaggagcacccagtccctggtgcactccaacggcaacacccacctgcactggttccagcagaggcctggacagagccccctgaggctgatctacagcgtgagcaacagggactccggcgtgcccgatagattcagcggcagcggctccggcaccgatttcaccctgaagatctccagagtggaagccgaggacgtgggcgtctactactgcagccagaccagccatatcccctacaccttcggcggcggcaccaagctggagatcaagggaggcggcggaagcggcggaggcggatccggaggcggaggctcccaagtgcagctggtgcagagcggcgctgagctgaagaagcccggagccagcgtgaaggtgagctgcaaggccagcggaaacaccctgaccaactacgtgatccactgggtgagacaggcccccggacagagactcgagtggatgggctacatcctgccctacaacgacctgaccaagtacagccagaagttccagggcagggtgacaatcaccagggacaagagcgccagcaccgcctacatggagctgagcagcctgagatccgaggacaccgccgtgtactactgcaccaggtgggactgggacggcttctttgacccctggggccagggaaccacagtgaccgtgtcctccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1439 - DNA, 1494 bp, Artificial Sequence
  Synthetic polynucleotide
atggcgcttccggtgacagcactgctcctccccttggcgctgttgctccacgcagcaaggccggaggtgcagctgcagcagagcggccctgagctggtgaagcccggcgccagcgtgaagatcagctgcaagacctccggctatacctttaccgagtacaccatcaactgggtgaagcagagccacggcaagagcctggagtggatcggcgatatctaccccgacaactacaacatcaggtacaaccagaagttcaagggcaaggccaccctgaccgtggacaagtccagcagcaccgcctacatggagctgaggagcctgtccagcgaggactccgccatctactactgcgccaaccacgactttttcgtcttctggggacagggcaccctggtgacagtgtccgctggcggcggcggcagcggcggcggcggctccggaggcggcggcagcgacatccagatgacacaggccacaagctccctgtccgccagcctgggcgatagggtgaccatcaattgcaggacctcccaggacatcagcaaccacctgaactggtaccagcagaaacccgacggcaccgtgaagctgctcatctactacaccagcaggctgcagtccggcgtccctagcagattcagcggatccggcagcggcaccgactatagcctgaccatcagcaacctcgagcaggaggacatcggcacctacttctgccatcagggcaacaccctgccccctacctttggcggcggcacaaagctggagattaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1440 - DNA, 1494 bp, Artificial Sequence
  Synthetic polynucleotide
atggcgcttccggtgacagcactgctcctccccttggcgctgttgctccacgcagcaaggccggatatccagatgacccaggccaccagcagcctgagcgcttccctcggcgacagggtgaccatcaactgcaggaccagccaggacatctccaaccacctgaactggtaccagcagaagcccgacggcaccgtgaaactgctgatctactacaccagcagactgcagagcggcgtgccctccagattttccggcagcggctccggcaccgactacagcctgaccattagcaacctggagcaggaggacatcggaacctacttctgccaccagggcaacacactgcctcccaccttcggcggcggcacaaagctcgagatcaagggcggcggcggaagcggcggcggcggcagcggcggcggaggctccgaggtgcaactgcaacagagcggacctgagctggtgaagcctggcgccagcgtgaagatctcctgtaagaccagcggctacaccttcaccgagtacaccatcaactgggtgaagcagagccacggcaagagcctcgaatggatcggcgacatctatcccgacaactacaatatcagatacaaccagaagttcaagggaaaggccaccctgaccgtggataagtcctcctccaccgcttacatggagctgaggagcctgagcagcgaggactccgccatctactactgcgccaaccacgacttcttcgtgttctggggccaaggcaccctcgtgaccgtgagcgccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1441 - DNA, 1494 bp, Artificial Sequence
  Synthetic polynucleotide
atggcgcttccggtgacagcactgctcctccccttggcgctgttgctccacgcagcaaggccgcaggtgcagctggtgcagtccggcgctgagctgaagaagcccggcgccagcgtgaagatcagctgcaaggccagcggctacaccttcaccgaatacaccatcaactgggtgagacaggcccctggacagaggctcgagtggatgggcgacatctaccccgacaactacagcatcaggtacaaccagaagttccagggcagggtgacaatcaccagggacaccagcgccagcaccgcctatatggagctgagcagcctgagatccgaggacaccgccgtctattactgcgccaaccacgacttcttcgtgttctggggccagggaacactggtgaccgtgtccagcggcggcggcggcagcggcggcggaggaagcggcggcggcggcagcgatatccagatgacccagagcccctcctccctgagcgctagcgtgggcgacagggtgaccattacctgtcaggcctcccaggacatcagcaactacctgaactggtaccagcagaagcctggcaaggcccccaagctgctgatctattacaccagcaggctggagaccggcgtgccctccagattcagcggctccggctccggaaccgacttcaccttcaccatcagctccctgcagcctgaggacatcgccacctactactgccagcagggcaacaccctgcctcccacattcggcggcggcacaaaggtggagatcaaaagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1442 - DNA, 1494 bp, Artificial Sequence
  Synthetic polynucleotide
atggcgcttccggtgacagcactgctcctccccttggcgctgttgctccacgcagcaaggccgcaggtgcagctggtccagtccggcgccgaactgaagaagcctggcgccagcgtgaagatcagctgcaaggcctccggctacaccttcaccgagtacaccatcaactgggtgaggcaagcccccggccagagactggagtggatgggcgacatctaccccgacaactacagcatcaggtacaaccagaagttccagggcagggtgacaatcaccagggataccagcgccagcacagcctatatggagctgtcctccctgagatccgaggacaccgccgtgtattactgcgccaaccacgacttcttcgtgttctggggccaaggcaccctggtgaccgtgagcagcggcggcggcggctccggcggcggaggctccggaggcggaggcagcgacatccagatgacccagagcccttccagcctgagcgctagcctgggcgacagggtgaccatcacctgcaggaccagccaggacatcagcaatcacctgaactggtaccagcaaaagcccggcaaggcccctaagctgctgatctactacaccagcaggctggaaagcggcgtgcctagcaggttcagcggcagcggctccggaaccgactacagcctgaccattagcagcctgcaacctgaggacatcggcacctattactgccagcagggcaacaccctgcctcctacctttggcggcggcaccaaactcgagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1443 - DNA, 1494 bp, Artificial Sequence
  Synthetic polynucleotide
atggcgcttccggtgacagcactgctcctccccttggcgctgttgctccacgcagcaaggccgcaggtgcagctggtgcagagcggccctgagctgaagaagcccggagccagcgtgaagatctcctgcaagacctccggctacaccttcaccgagtacaccatcaactgggtgaagcaggcccccggacagggactggaatggatcggcgacatctaccccgacaactacaacatcaggtacaaccagaagttccaaggcaaggccaccatcacaagggacaccagcagcagcaccgcctacatggagctgagcagcctgaggagcgaggataccgccgtgtactactgcgccaaccacgacttcttcgtgttctggggccagggcaccctggtgacagtgagcagcggaggaggcggaagcggaggaggaggatccggaggaggaggcagcgacatccagatgacccagtccccctcctccctgagcgcctccgtgggagacagggtgaccatcacctgccaggccagccaggacatcagcaactacctgaactggtaccagcagaagcccggcaaggcccccaagctgctgatttactacaccagcaggctggaaaccggcgtgcccagcagatttagcggcagcggcagcggcaccgactttacctttaccatctccagcctgcagcccgaggatatcgccacatactactgccagcagggcaacaccctcccccctacctttggcggcggcaccaaggtggagattaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1444 - DNA, 1494 bp, Artificial Sequence
  Synthetic polynucleotide
atggcgcttccggtgacagcactgctcctccccttggcgctgttgctccacgcagcaaggccgcaggtgcagctggtgcagtccggccccgaactgaaaaagcccggcgccagcgtcaagatcagctgcaagacctccggctacaccttcaccgagtacaccatcaactgggtgaagcaggcccccggccagggactggaatggattggcgacatctaccccgacaactacaacattaggtataaccagaagttccagggcaaggccaccatcacaagagacaccagcagcagcaccgcctacatggagctgagcagcctgaggagcgaggacaccgccgtgtactactgcgccaaccacgacttcttcgtgttctggggccagggaaccctggtgacagtgtccagcggcggcggcggctccggcggcggcggctccggcggcggcggcagcgacattcagatgacacagagcccctccagcctgagcgccagcctgggcgatagggtgaccatcacctgcagaaccagccaggacatcagcaaccacctgaattggtaccagcagaagcccggaaaggcccccaaactgctgatctactacaccagcaggctggagagcggcgtgcctagcaggtttagcggcagcggcagcggcacagattacagcctgaccatcagcagcctgcagcccgaagacatcggcacctactactgccagcagggcaacaccctgccccctacctttggcggaggcaccaagctggagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1445 - DNA, 1494 bp, Artificial Sequence
  Synthetic polynucleotide
atggcgcttccggtgacagcactgctcctccccttggcgctgttgctccacgcagcaaggccggacatccagatgacacagagccctagcagcctgagcgcttccgtgggcgacagggtgaccatcacctgccaggccagccaggacatcagcaactacctcaactggtaccagcagaagcccggcaaggcccctaagctgctgatctactacacctccaggctggagaccggagtgccctccagattttccggcagcggcagcggcaccgatttcaccttcaccatcagcagcctgcagcccgaggacatcgccacctactattgccagcagggcaacaccctgccccccacatttggaggcggcaccaaggtggagatcaagggcggaggaggaagcggaggaggaggaagcggaggaggcggaagccaggtgcagctggtgcagagcggcgctgagctcaagaagcctggcgccagcgtgaagatcagctgcaaagcctccggatacaccttcaccgagtacaccatcaattgggtgagacaggcccccggccaaagactggagtggatgggcgacatctatcccgacaactacagcatcaggtacaaccagaagttccagggcagggtgacaatcaccagagacaccagcgccagcaccgcctacatggagctgagcagcctgaggagcgaggacaccgccgtgtactactgcgccaatcacgacttcttcgtgttctggggccagggaaccctggtgaccgtcagctccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1446 - DNA, 1494 bp, Artificial Sequence
  Synthetic polynucleotide
atggcgcttccggtgacagcactgctcctccccttggcgctgttgctccacgcagcaaggccggatatccagatgacacagagccctagctccctgagcgccagcctgggcgatagggtgaccatcacctgcaggacctcccaggacatcagcaaccacctgaactggtaccagcagaagcccggcaaagcccccaagctgctgatctactacaccagcaggctggaaagcggcgtgcccagcaggtttagcggaagcggcagcggcaccgactacagcctgaccatcagctccctgcagcccgaggacatcggcacctactactgccagcagggcaacaccctgcctcccaccttcggaggcggaaccaagctggagattaagggaggcggcggaagcggcggcggcggctccggcggaggaggcagccaggtgcagctggtgcagtccggagccgagctgaaaaagcctggcgccagcgtgaagatcagctgcaaggccagcggctacaccttcaccgagtacaccatcaactgggtgaggcaggcccctggccagagactcgagtggatgggcgacatctaccccgacaactactccatcaggtacaaccagaagtttcagggcagggtgaccattaccagggacaccagcgccagcacagcctacatggagctgagcagcctgaggagcgaggatacagccgtctactactgcgccaaccacgactttttcgtgttctggggacagggcaccctggtgaccgtgtcctccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1447 - DNA, 1494 bp, Artificial Sequence
  Synthetic polynucleotide
atggcgcttccggtgacagcactgctcctccccttggcgctgttgctccacgcagcaaggccggacatccaaatgacccagagccctagctccctgagcgcttccgtgggcgacagagtgaccattacctgccaggccagccaggacatcagcaactacctgaactggtatcagcagaagcctggcaaggcccccaagctgctgatctactacaccagcaggctggagaccggagtgcccagcaggtttagcggctccggatccggcaccgacttcaccttcaccatctccagcctgcagcccgaggacatcgccacctactactgccagcagggcaataccctcccccctaccttcggaggcggcaccaaggtggagatcaagggcggcggcggctccggcggcggcggcagcggcggaggcggcagccaggtgcaactggtgcagagcggccctgagctgaagaaacccggcgccagcgtgaaaatcagctgcaagaccagcggctacacattcaccgagtacaccatcaactgggtgaagcaggctcccggacagggactggagtggatcggcgacatctaccctgacaactacaacatcagatacaaccaaaagttccagggcaaggccaccatcaccagggacaccagctcctccaccgcctacatggagctgagcagcctgaggagcgaggacaccgctgtgtactactgcgccaaccacgacttcttcgtgttctggggccagggaaccctggtgaccgtgagcagcagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1448 - DNA, 1494 bp, Artificial Sequence
  Synthetic polynucleotide
atggcgcttccggtgacagcactgctcctccccttggcgctgttgctccacgcagcaaggccggatatccagatgacacaaagccccagcagcctgtccgctagcctgggcgatagggtgaccatcacatgcaggaccagccaggacatctccaaccacctgaactggtaccagcagaagcctggaaaggcccccaaactgctgatctactacaccagcaggctggagagcggcgtgcctagcaggttttccggcagcggcagcggcaccgactatagcctgaccatcagctccctgcagcccgaggacatcggcacctactactgccagcagggaaacacactgccccccacctttggcggcggcacaaagctggagatcaagggcggcggcggatccggcggcggaggcagcggaggaggaggaagccaggtgcagctggtgcagtccggccctgagctgaagaagcccggagccagcgtgaaaattagctgcaagacctccggctacacattcaccgagtacaccatcaactgggtgaagcaggctcccggccagggactggagtggatcggcgacatctaccccgacaactacaacatcaggtacaaccagaaattccagggcaaggccaccatcaccagggacaccagctcctccaccgcctatatggagctgtccagcctgagaagcgaggataccgccgtgtactactgcgccaaccacgatttcttcgtgttctggggccagggcacactggtcaccgtgagcagcagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccaga

SEQ ID NO: 1449 - protein, 506 aa, Artificial Sequence
  Synthetic polypeptide
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKGGGGSGGGGSGGGGSGQVQLVQSGAEVKKPGASVKVSCKASGYTFTNYGMNWVRQAPGQGLKWMGWINTYTGEPTYADAFKGRVTMTRDTSISTAYMELSRLRSDDTAVYYCARDYGDYGMDYWGQGTTVTVSSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1450 - protein, 506 aa, Artificial Sequence
  Synthetic polypeptide
MALPVTALLLPLALLLHAARPQVQLVQSGAEVKKPGASVKVSCKASGYTFTNYGMNWVRQAPGQGLKWMGWINTYTGEPTYADAFKGRVTMTRDTSISTAYMELSRLRSDDTAVYYCARDYGDYGMDYWGQGTTVTVSSGGGGSGGGGSGGGGSGDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1451 - protein, 504 aa, Artificial Sequence
  Synthetic polypeptide
MALPVTALLLPLALLLHAARPQVQLQQSGGGLVQPGGSLKLSCAASGIDFSRYWMSWVRRAPGKGLEWIGEINPDSSTINYAPSLKDKFIISRDNAKNTLYLQMSKVRSEDTALYYCASLYYDYGDAMDYWGQGTSVTVSSGGGGSGGGGSGGGGSGDIVMTQSQRFMTTSVGDRVSVTCKASQSVDSNVAWYQQKPRQSPKALIFSASLRFSGVPARFTGSGSGTDFTLTISNLQSEDLAEYFCQQYNNYPLTFGAGTKLELKSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1452 - protein, 504 aa, Artificial Sequence
  Synthetic polypeptide
MALPVTALLLPLALLLHAARPDIVMTQSQRFMTTSVGDRVSVTCKASQSVDSNVAWYQQKPRQSPKALIFSASLRFSGVPARFTGSGSGTDFTLTISNLQSEDLAEYFCQQYNNYPLTFGAGTKLELKGGGGSGGGGSGGGGSGQVQLQQSGGGLVQPGGSLKLSCAASGIDFSRYWMSWVRRAPGKGLEWIGEINPDSSTINYAPSLKDKFIISRDNAKNTLYLQMSKVRSEDTALYYCASLYYDYGDAMDYWGQGTSVTVSSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1453 - protein, 503 aa, Artificial Sequence
  Synthetic polypeptide
MALPVTALLLPLALLLHAARPEVQLVESGGGLVQPGGSLKLSCAASGIDFSRYWMSWVRQAPGKGLEWIGEINPDSSTINYADSVKGRFTISRDNAKNTLYLQMNLSRAEDTALYYCASLYYDYGDAMDYWGQGTLVTVSSGGGGSGGGGSGGGGSDIQMTQSPSSLSASVGDRVTITCRASQSVDSNVAWYQQKPEKAPKSLIFSASLRFSGVPSRFSGSGSGTDFTLTISSLQPEDFATYYCQQYNSYPLTFGAGTKLEIKSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1454 - protein, 505 aa, Artificial Sequence
  Synthetic polypeptide
MALPVTALLLPLALLLHAARPEVQLVESGGGLVQPGGSLKLSCAASGIDFSRYWMSWVRQAPGKGLEWIGEINPDSSTINYADSVKGRFTISRDNAKNTLYLQMNLSRAEDTALYYCASLYYDYGDAMDYWGQGTLVTVSSGGGGSGGGGSGGGGSDIQMTQSPSSLSASVGDRVTITCRASQSVDSNVAWYQQKPEKAPKSLIFSASLRFSGVPSRFSGSGSGTDFTLTISSLQPEDFATYYCQQYNSYPLTFGAGTKLEIKSAAAFVPVFLPAKPTTTPAPRPPTPAPTIASQPLSLRPEACRPAAGGAVHTRGLDFACDIYIWAPLAGTCGVLLLSLVITLYCNHRNRKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1455 - protein, 503 aa, Artificial Sequence
  Synthetic polypeptide
MALPVTALLLPLALLLHAARPEVQLVESGGGLVQPGGSLKLSCAASGIDFSRYWMSWVRQAPGKGLEWIGEINPDSSTINYADSVKGRFTISRDNAKNTLYLQMNLSRAEDTALYYCASLYYDYGDAMDYWGQGTLVTVSSGGGGSGGGGSGGGGSDIQMTQSPSSLSASPGDRVSVTCKASQSVDSNVAWYQQKPRQAPKALIFSASLRFSGVPARFTGSGSGTDFTLTISNLQSEDFATYYCQQYNNYPLTFGAGTKLEIKSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1456 - protein, 503 aa, Artificial Sequence
  Synthetic polypeptide
MALPVTALLLPLALLLHAARPDIQMTQSPSSLSASVGDRVTITCRASQSVDSNVAWYQQKPEKAPKSLIFSASLRFSGVPSRFSGSGSGTDFTLTISSLQPEDFATYYCQQYNSYPLTFGAGTKLEIKGGGGSGGGGSGGGGSEVQLVESGGGLVQPGGSLKLSCAASGIDFSRYWMSWVRQAPGKGLEWIGEINPDSSTINYADSVKGRFTISRDNAKNTLYLQMNLSRAEDTALYYCASLYYDYGDAMDYWGQGTLVTVSSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1457 - protein, 503 aa, Artificial Sequence
  Synthetic polypeptide
MALPVTALLLPLALLLHAARPDIQMTQSPSSLSASPGDRVSVTCKASQSVDSNVAWYQQKPRQAPKALIFSASLRFSGVPARFTGSGSGTDFTLTISNLQSEDFATYYCQQYNNYPLTFGAGTKLEIKGGGGSGGGGSGGGGSEVQLVESGGGLVQPGGSLKLSCAASGIDFSRYWMSWVRQAPGKGLEWIGEINPDSSTINYADSVKGRFTISRDNAKNTLYLQMNLSRAEDTALYYCASLYYDYGDAMDYWGQGTLVTVSSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1458 - protein, 506 aa, Artificial Sequence
  Synthetic polypeptide
MALPVTALLLPLALLLHAARPEVQLQQSGPELVKPGASVKMSCKASGNTLTNYVIHWMKQMPGQGLDWIGYILPYNDLTKYNEKFTGKATLTSDKSSSSAYMELNSLTSEDSAVYYCTRWDWDGFFDPWGQGTTLTVSSGGGGSGGGGSGGGGSDIVMTQSPLSLPVSLGDQASISCRSTQSLVHSNGNTHLHWYLQRPGQSPKLLIYSVSNRFSEVPDRFSASGSGTDFTLKISRVEAEDLGVYFCSQTSHIPYTFGGGTKLEIKSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1459 - protein, 506 aa, Artificial Sequence
  Synthetic polypeptide
MALPVTALLLPLALLLHAARPDIVMTQSPLSLPVSLGDQASISCRSTQSLVHSNGNTHLHWYLQRPGQSPKLLIYSVSNRFSEVPDRFSASGSGTDFTLKISRVEAEDLGVYFCSQTSHIPYTFGGGTKLEIKGGGGSGGGGSGGGGSEVQLQQSGPELVKPGASVKMSCKASGNTLTNYVIHWMKQMPGQGLDWIGYILPYNDLTKYNEKFTGKATLTSDKSSSSAYMELNSLTSEDSAVYYCTRWDWDGFFDPWGQGTTLTVSSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1460 - protein, 506 aa, Artificial Sequence
  Synthetic polypeptide
MALPVTALLLPLALLLHAARPQVQLVQSGAELKKPGASVKVSCKASGNTLTNYVIHWVRQAPGQRLEWMGYILPYNDLTKYSQKFQGRVTITRDKSASTAYMELSSLRSEDTAVYYCTRWDWDGFFDPWGQGTTVTVSSGGGGSGGGGSGGGGSEIVMTQSPATLSVSPGERASISCRASQSLVHSNGNTHLHWYQQRPGQAPRLLIYSVSNRFSEVPARFSGSGSGTDFTLTISSVESEDFAVYYCSQTSHIPYTFGGGTKLEIKSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1461 - protein, 508 aa, Artificial Sequence
  Synthetic polypeptide
MALPVTALLLPLALLLHAARPQVQLVQSGAELKKPGASVKVSCKASGNTLTNYVIHWVRQAPGQRLEWMGYILPYNDLTKYSQKFQGRVTITRDKSASTAYMELSSLRSEDTAVYYCTRWDWDGFFDPWGQGTTVTVSSGGGGSGGGGSGGGGSEIVMTQSPATLSVSPGERASISCRASQSLVHSNGNTHLHWYQQRPGQAPRLLIYSVSNRFSEVPARFSGSGSGTDFTLTISSVESEDFAVYYCSQTSHIPYTFGGGTKLEIKSAAAFVPVFLPAKPTTTPAPRPPTPAPTIASQPLSLRPEACRPAAGGAVHTRGLDFACDIYIWAPLAGTCGVLLLSLVITLYCNHRNRKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1462 - protein, 506 aa, Artificial Sequence
  Synthetic polypeptide
MALPVTALLLPLALLLHAARPQVQLVQSGAELKKPGASVKVSCKASGNTLTNYVIHWVRQAPGQRLEWMGYILPYNDLTKYSQKFQGRVTITRDKSASTAYMELSSLRSEDTAVYYCTRWDWDGFFDPWGQGTTVTVSSGGGGSGGGGSGGGGSDIVMTQSPLSLPVTLGQPATLSCRSTQSLVHSNGNTHLHWFQQRPGQSPLRLIYSVSNRDSGVPDRFSGSGSGTDFTLKISRVEAEDVGVYYCSQTSHIPYTFGGGTKLEIKSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1463 - protein, 506 aa, Artificial Sequence
  Synthetic polypeptide
MALPVTALLLPLALLLHAARPEIVMTQSPATLSVSPGERASISCRASQSLVHSNGNTHLHWYQQRPGQAPRLLIYSVSNRFSEVPARFSGSGSGTDFTLTISSVESEDFAVYYCSQTSHIPYTFGGGTKLEIKGGGGSGGGGSGGGGSQVQLVQSGAELKKPGASVKVSCKASGNTLTNYVIHWVRQAPGQRLEWMGYILPYNDLTKYSQKFQGRVTITRDKSASTAYMELSSLRSEDTAVYYCTRWDWDGFFDPWGQGTTVTVSSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1464 - protein, 506 aa, Artificial Sequence
  Synthetic polypeptide
MALPVTALLLPLALLLHAARPDIVMTQSPLSLPVTLGQPATLSCRSTQSLVHSNGNTHLHWFQQRPGQSPLRLIYSVSNRDSGVPDRFSGSGSGTDFTLKISRVEAEDVGVYYCSQTSHIPYTFGGGTKLEIKGGGGSGGGGSGGGGSQVQLVQSGAELKKPGASVKVSCKASGNTLTNYVIHWVRQAPGQRLEWMGYILPYNDLTKYSQKFQGRVTITRDKSASTAYMELSSLRSEDTAVYYCTRWDWDGFFDPWGQGTTVTVSSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1465 - protein, 498 aa, Artificial Sequence
  Synthetic polypeptide
MALPVTALLLPLALLLHAARPEVQLQQSGPELVKPGASVKISCKTSGYTFTEYTINWVKQSHGKSLEWIGDIYPDNYNIRYNQKFKGKATLTVDKSSSTAYMELRSLSSEDSAIYYCANHDFFVFWGQGTLVTVSAGGGGSGGGGSGGGGSDIQMTQATSSLSASLGDRVTINCRTSQDISNHLNWYQQKPDGTVKLLIYYTSRLQSGVPSRFSGSGSGTDYSLTISNLEQEDIGTYFCHQGNTLPPTFGGGTKLEIKSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1466 - protein, 498 aa, Artificial Sequence
  Synthetic polypeptide
MALPVTALLLPLALLLHAARPDIQMTQATSSLSASLGDRVTINCRTSQDISNHLNWYQQKPDGTVKLLIYYTSRLQSGVPSRFSGSGSGTDYSLTISNLEQEDIGTYFCHQGNTLPPTFGGGTKLEIKGGGGSGGGGSGGGGSEVQLQQSGPELVKPGASVKISCKTSGYTFTEYTINWVKQSHGKSLEWIGDIYPDNYNIRYNQKFKGKATLTVDKSSSTAYMELRSLSSEDSAIYYCANHDFFVFWGQGTLVTVSASAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1467 - protein, 498 aa, Artificial Sequence
  Synthetic polypeptide
MALPVTALLLPLALLLHAARPQVQLVQSGAELKKPGASVKISCKASGYTFTEYTINWVRQAPGQRLEWMGDIYPDNYSIRYNQKFQGRVTITRDTSASTAYMELSSLRSEDTAVYYCANHDFFVFWGQGTLVTVSSGGGGSGGGGSGGGGSDIQMTQSPSSLSASVGDRVTITCQASQDISNYLNWYQQKPGKAPKLLIYYTSRLETGVPSRFSGSGSGTDFTFTISSLQPEDIATYYCQQGNTLPPTFGGGTKVEIKSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1468 - protein, 498 aa, Artificial Sequence
  Synthetic polypeptide
MALPVTALLLPLALLLHAARPQVQLVQSGAELKKPGASVKISCKASGYTFTEYTINWVRQAPGQRLEWMGDIYPDNYSIRYNQKFQGRVTITRDTSASTAYMELSSLRSEDTAVYYCANHDFFVFWGQGTLVTVSSGGGGSGGGGSGGGGSDIQMTQSPSSLSASLGDRVTITCRTSQDISNHLNWYQQKPGKAPKLLIYYTSRLESGVPSRFSGSGSGTDYSLTISSLQPEDIGTYYCQQGNTLPPTFGGGTKLEIKSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1469 - protein, 498 aa, Artificial Sequence
  Synthetic polypeptide
MALPVTALLLPLALLLHAARPQVQLVQSGPELKKPGASVKISCKTSGYTFTEYTINWVKQAPGQGLEWIGDIYPDNYNIRYNQKFQGKATITRDTSSSTAYMELSSLRSEDTAVYYCANHDFFVFWGQGTLVTVSSGGGGSGGGGSGGGGSDIQMTQSPSSLSASVGDRVTITCQASQDISNYLNWYQQKPGKAPKLLIYYTSRLETGVPSRFSGSGSGTDFTFTISSLQPEDIATYYCQQGNTLPPTFGGGTKVEIKSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1470 - protein, 498 aa, Artificial Sequence
  Synthetic polypeptide
MALPVTALLLPLALLLHAARPQVQLVQSGPELKKPGASVKISCKTSGYTFTEYTINWVKQAPGQGLEWIGDIYPDNYNIRYNQKFQGKATITRDTSSSTAYMELSSLRSEDTAVYYCANHDFFVFWGQGTLVTVSSGGGGSGGGGSGGGGSDIQMTQSPSSLSASLGDRVTITCRTSQDISNHLNWYQQKPGKAPKLLIYYTSRLESGVPSRFSGSGSGTDYSLTISSLQPEDIGTYYCQQGNTLPPTFGGGTKLEIKSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1471 - protein, 498 aa, Artificial Sequence
  Synthetic polypeptide
MALPVTALLLPLALLLHAARPDIQMTQSPSSLSASVGDRVTITCQASQDISNYLNWYQQKPGKAPKLLIYYTSRLETGVPSRFSGSGSGTDFTFTISSLQPEDIATYYCQQGNTLPPTFGGGTKVEIKGGGGSGGGGSGGGGSQVQLVQSGAELKKPGASVKISCKASGYTFTEYTINWVRQAPGQRLEWMGDIYPDNYSIRYNQKFQGRVTITRDTSASTAYMELSSLRSEDTAVYYCANHDFFVFWGQGTLVTVSSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1472 - protein, 498 aa, Artificial Sequence
  Synthetic polypeptide
MALPVTALLLPLALLLHAARPDIQMTQSPSSLSASLGDRVTITCRTSQDISNHLNWYQQKPGKAPKLLIYYTSRLESGVPSRFSGSGSGTDYSLTISSLQPEDIGTYYCQQGNTLPPTFGGGTKLEIKGGGGSGGGGSGGGGSQVQLVQSGAELKKPGASVKISCKASGYTFTEYTINWVRQAPGQRLEWMGDIYPDNYSIRYNQKFQGRVTITRDTSASTAYMELSSLRSEDTAVYYCANHDFFVFWGQGTLVTVSSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1473 - protein, 498 aa, Artificial Sequence
  Synthetic polypeptide
MALPVTALLLPLALLLHAARPDIQMTQSPSSLSASVGDRVTITCQASQDISNYLNWYQQKPGKAPKLLIYYTSRLETGVPSRFSGSGSGTDFTFTISSLQPEDIATYYCQQGNTLPPTFGGGTKVEIKGGGGSGGGGSGGGGSQVQLVQSGPELKKPGASVKISCKTSGYTFTEYTINWVKQAPGQGLEWIGDIYPDNYNIRYNQKFQGKATITRDTSSSTAYMELSSLRSEDTAVYYCANHDFFVFWGQGTLVTVSSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1474 - protein, 498 aa, Artificial Sequence
  Synthetic polypeptide
MALPVTALLLPLALLLHAARPDIQMTQSPSSLSASLGDRVTITCRTSQDISNHLNWYQQKPGKAPKLLIYYTSRLESGVPSRFSGSGSGTDYSLTISSLQPEDIGTYYCQQGNTLPPTFGGGTKLEIKGGGGSGGGGSGGGGSQVQLVQSGPELKKPGASVKISCKTSGYTFTEYTINWVKQAPGQGLEWIGDIYPDNYNIRYNQKFQGKATITRDTSSSTAYMELSSLRSEDTAVYYCANHDFFVFWGQGTLVTVSSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1475 - DNA, 735 bp, Artificial Sequence
  Synthetic polynucleotide
gatatagttatgacccaatcacccgatagtcttgcggtaagcctgggggagcgagcaacaataaactgtcgggcatcaaaatccgtcagtacaagcgggtattcattcatgcactggtatcaacagaaacccggtcagccacccaagctcctgatttatcttgcgtctaatcttgagtccggcgtcccagaccggttttccggctccgggagcggcacggattttactcttactatttctagccttcaggccgaagatgtggcggtatactactgccagcattcaagggaagttccttggacgttcggtcagggcacgaaagtggaaattaaaggcggggggggatccggcgggggagggtctggaggaggtggcagtggtcaggtccaactggtgcagtccggggcagaggtaaaaaaacccggcgcgtctgttaaggtttcatgcaaggccagtggatatactttcaccaattacggaatgaactgggtgaggcaggcccctggtcaaggcctgaaatggatgggatggataaacacgtacaccggtgaacctacctatgccgatgcctttaagggtcgggttacgatgacgagagacacctccatatcaacagcctacatggagctcagcagattgaggagtgacgatacggcagtctattactgtgcaagagactacggcgattatggcatggattactggggccagggcactacagtaaccgtttccagc

SEQ ID NO: 1476 - DNA, 735 bp, Artificial Sequence
  Synthetic polynucleotide
caggtccagttggtgcaaagcggggcggaggtgaaaaaacccggcgcttccgtgaaggtgtcctgtaaggcgtccggttatacgttcacgaactacgggatgaattgggttcgccaagcgccggggcagggactgaaatggatggggtggataaatacctacaccggcgaacctacatacgccgacgcttttaaagggcgagtcactatgacgcgcgataccagcatatccaccgcatacatggagctgtcccgactccggtcagacgacacggctgtctactattgtgctcgggactatggcgattatggcatggactactggggtcagggtacgactgtaacagttagtagtggtggaggcggcagtggcggggggggaagcggaggagggggttctggtgacatagttatgacccaatccccagatagtttggcggtttctctgggcgagagggcaacgattaattgtcgcgcatcaaagagcgtttcaacgagcggatattcttttatgcattggtaccagcaaaaacccggacaaccgccgaagctgctgatctacttggcttcaaatcttgagtctggggtgccggaccgattttctggtagtggaagcggaactgactttacgctcacgatcagttcactgcaggctgaggatgtagcggtctattattgccagcacagtagagaagtcccctggaccttcggtcaaggcacgaaagtagaaattaaa

SEQ ID NO: 1477 - DNA, 729 bp, Artificial Sequence
  Synthetic polynucleotide
caggtgcagttacaacagtcaggaggaggattagtgcagccaggaggatctctgaaactgtcttgtgccgccagcggaatcgattttagcaggtactggatgtcttgggtgagaagagcccctggaaaaggactggagtggatcggcgagattaatcctgatagcagcaccatcaactatgcccctagcctgaaggacaagttcatcatcagccgggacaatgccaagaacaccctgtacctgcaaatgagcaaggtgaggagcgaggatacagctctgtactactgtgccagcctgtactacgattacggagatgctatggactattggggccagggaacaagcgttacagtgtcttctggaggaggaggatccggtggtggtggttcaggaggtggaggttcgggagatattgtgatgacacaaagccagcggttcatgaccacatctgtgggcgacagagtgagcgtgacctgtaaagcttctcagtctgtggacagcaatgttgcctggtatcagcagaagcccagacagagccctaaagccctgatcttttctgccagcctgagattttctggcgttcctgccagatttaccggctctggctctggcaccgattttacactgaccatcagcaatctgcagtctgaggatctggccgagtacttttgccagcagtacaacaactaccccctgacctttggagctggcacaaaactggagctgaag

SEQ ID NO: 1478 - DNA, 729 bp, Artificial Sequence
  Synthetic polynucleotide
gacatcgtgatgacccaaagccagaggttcatgaccacatctgtgggcgatagagtgagcgtgacctgtaaagcctctcagtctgtggacagcaatgttgcctggtatcagcagaagcctagacagagccctaaagccctgatctttagcgccagcctgagatttagcggagttcctgccagatttaccggaagcggatctggaaccgattttacactgaccatcagcaacctgcagagcgaggatctggccgagtacttttgccagcagtacaacaattaccctctgacctttggagccggcacaaagctggagctgaaaggaggaggaggatctggtggtggtggttcaggaggtggaggttcgggacaagttcaattacagcaatctggaggaggactggttcagcctggaggaagcctgaagctgtcttgtgccgcttctggaatcgattttagcagatactggatgagctgggtgagaagagcccctggcaaaggactggagtggattggcgagattaatcctgatagcagcaccatcaactatgcccctagcctgaaggacaagttcatcatcagccgggacaatgccaagaacaccctgtacctgcaaatgagcaaggtgaggagcgaggatacagctctgtactactgtgccagcctgtactacgattacggagatgctatggactattggggccagggaacaagcgttacagtgagcagc

SEQ ID NO: 1479 - DNA, 726 bp, Artificial Sequence
  Synthetic polynucleotide
gaggtccagctggtggagagcggcggaggactggtccagcctggcggctccctgaaactgagctgcgccgccagcggcatcgacttcagcaggtactggatgagctgggtgagacaggcccctggcaagggcctggaatggatcggcgagatcaaccccgactccagcaccatcaactacgccgacagcgtcaagggcaggttcaccattagcagggacaatgccaagaacaccctgtacctgcagatgaacctgagcagggccgaagacaccgccctgtactactgtgccagcctgtactacgactatggcgacgctatggactactggggccagggcaccctggtgacagtgagctccggaggaggcggcagcggcggaggcggcagcggcggaggcggcagcgacatccagatgacccagagccctagcagcctgagcgcctccgtgggagatagggtgacaatcacctgtagggccagccagagcgtggactccaacgtggcctggtatcaacagaagcccgagaaggcccccaagagcctgatcttttccgcctccctgaggttcagcggagtccccagcaggttctccggatccggctccggaaccgactttaccctgaccatctccagcctgcagcccgaggacttcgccacctactactgccagcagtacaacagctaccccctgaccttcggcgccggcacaaagctggagatcaag

SEQ ID NO: 1480 - DNA, 726 bp, Artificial Sequence
  Synthetic polynucleotide
gaggtgcagctggtggagagcggaggaggactggtgcagcccggaggctccctgaagctgagctgcgctgcctccggcatcgacttcagcaggtactggatgagctgggtgaggcaggctcccggcaaaggcctggagtggatcggcgagatcaaccccgacagcagcaccatcaactacgccgacagcgtgaagggcaggttcaccatcagcagggacaacgccaagaataccctgtacctgcagatgaacctgagcagggccgaggacacagccctgtactactgtgccagcctgtactacgactatggagacgctatggactactggggccagggaaccctggtgaccgtgagcagcggaggcggaggctccggcggcggaggcagcggaggaggcggcagcgatatccagatgacccagtcccccagctccctgagcgctagccctggcgacagggtgagcgtgacatgcaaggccagccagagcgtggacagcaacgtggcctggtaccagcagaaacccagacaggcccccaaggccctgatcttcagcgccagcctgaggtttagcggcgtgcccgctaggtttaccggatccggcagcggcaccgacttcaccctgaccatctccaacctgcagtccgaggacttcgccacctactactgccagcagtacaacaactaccccctgacattcggcgccggaaccaagctggagatcaag

SEQ ID NO: 1481 - DNA, 726 bp, Artificial Sequence
  Synthetic polynucleotide
gacatccagatgacccagagccctagcagcctgagcgctagcgtgggcgacagggtgaccatcacctgcagggccagccagagcgtggactccaacgtggcctggtaccagcagaagcccgagaaggcccccaagagcctgatcttcagcgccagcctgaggttctccggagtgcctagcagatttagcggcagcggcagcggcacagacttcaccctgaccatcagcagcctccagcccgaggatttcgccacctactactgccagcagtacaactcctaccccctgaccttcggcgccggcacaaagctggagatcaagggaggaggaggaagcggaggaggaggaagcggaggcggaggaagcgaggtgcagctggtggagtccggaggaggcctggtgcaacctggaggcagcctgaagctgagctgtgccgccagcggaatcgacttcagcaggtactggatgtcctgggtgagacaggcccctggcaagggcctggagtggatcggagagatcaaccccgacagctccaccatcaactacgccgacagcgtgaagggcaggttcaccatcagcagagacaacgccaagaacaccctgtacctgcagatgaacctgtccagagccgaggacaccgccctgtactactgcgccagcctgtattacgactacggcgacgctatggactactggggccagggcaccctggtgacagtgagcagc

SEQ ID NO: 1482 - DNA, 726 bp, Artificial Sequence
  Synthetic polynucleotide
gacatccaaatgacccagtcccctagcagcctgtccgccagccctggagacagggtgtccgtgacctgcaaggccagccagtccgtggacagcaacgtcgcctggtatcagcagaagcccaggcaagctcccaaggctctgatcttctccgccagcctgagattttccggcgtgcccgccagattcaccggaagcggcagcggcaccgacttcaccctgaccatcagcaacctgcagagcgaggatttcgccacatactactgccagcagtacaacaactaccccctgaccttcggagccggcaccaagctggagatcaaaggcggcggaggcagcggcggcggcggcagcggcggaggcggatccgaagtgcagctggtggaaagcggaggcggactcgtgcagcctggcggaagcctgaagctgagctgtgccgccagcggcatcgacttcagcaggtactggatgagctgggtgaggcaggctcccggcaaaggcctggagtggatcggcgagatcaaccctgacagcagcaccatcaactacgccgacagcgtgaaaggcaggttcaccatcagcagggacaacgccaagaacaccctgtacctgcagatgaacctgtccagagccgaggacaccgccctgtactactgcgccagcctgtactacgactacggcgacgctatggactactggggccaaggcaccctcgtgaccgtcagctcc

SEQ ID NO: 1483 - DNA, 735 bp, Artificial Sequence
  Synthetic polynucleotide
gaggtgcagctgcagcagtccggccctgagctcgtgaagcctggagccagcgtgaaaatgagctgtaaggcctccggcaacaccctcaccaactacgtgatccattggatgaagcagatgcccggccagggcctggactggattggctacattctgccctacaacgacctgaccaagtacaacgagaagttcaccggcaaggccaccctgaccagcgataagagctccagcagcgcctacatggagctgaactccctgaccagcgaggacagcgccgtgtactactgcaccaggtgggactgggatggcttcttcgacccctggggacagggcaccaccctgacagtgtccagcggaggaggcggcagcggcggcggcggctccggcggcggcggcagcgatatcgtgatgacacagtcccctctgagcctgcctgtgagcctgggcgaccaggccagcatcagctgcaggtccacccagtccctggtgcactccaacggcaacacccacctgcactggtacctgcaaaggcccggccagtcccctaagctgctgatctacagcgtgagcaacaggtttagcgaggtgcccgatagattttccgccagcggcagcggcaccgacttcacactgaagatctccagggtggaggccgaggatctgggcgtgtacttctgcagccagaccagccacatcccctacaccttcggcggcggaaccaagctggagatcaag

SEQ ID NO: 1484 - DNA, 735 bp, Artificial Sequence
  Synthetic polynucleotide
gacatcgtgatgacccagagccccctgagcctgcctgtgtccctgggagaccaggcttccatcagctgcaggtccacccagagcctggtgcactccaacggcaacacccacctgcactggtacctgcagaggcctggccagtcccccaagctgctgatctacagcgtgagcaataggttcagcgaggtgcccgacagattcagcgccagcggaagcggcaccgacttcaccctgaagatcagcagggtcgaggccgaagatctgggcgtgtacttctgctcccagacatcccacatcccttacaccttcggcggcggcaccaagctggagattaagggcggcggaggatccggcggaggaggatccggaggaggaggaagcgaggtgcagctgcagcagagcggacccgagctggtgaaacccggagccagcgtcaaaatgagctgcaaggccagcggcaacaccctgaccaactacgtcatccactggatgaagcagatgcccggacagggcctggactggatcggctacatcctgccctacaacgacctgaccaagtacaacgagaaattcaccggcaaggccaccctgaccagcgacaagagcagcagcagcgcctacatggagctgaacagcctgaccagcgaggactccgccgtgtactattgcaccaggtgggactgggacggcttctttgacccctggggccagggcacaacactcaccgtgagctcc

SEQ ID NO: 1485 - DNA, 735 bp, Artificial Sequence
  Synthetic polynucleotide
caggtgcagctggtgcagagcggagccgagctcaagaagcccggagcctccgtgaaggtgagctgcaaggccagcggcaacaccctgaccaactacgtgatccactgggtgagacaagcccccggccaaaggctggagtggatgggctacatcctgccctacaacgacctgaccaagtacagccagaagttccagggcagggtgaccatcaccagggataagagcgcctccaccgcctatatggagctgagcagcctgaggagcgaggacaccgctgtgtactactgtacaaggtgggactgggacggcttctttgacccctggggccagggcacaacagtgaccgtcagcagcggcggcggaggcagcggcggcggcggcagcggcggaggcggaagcgaaatcgtgatgacccagagccccgccacactgagcgtgagccctggcgagagggccagcatctcctgcagggctagccaaagcctggtgcacagcaacggcaacacccacctgcactggtaccagcagagacccggacaggctcccaggctgctgatctacagcgtgagcaacaggttctccgaggtgcctgccaggtttagcggcagcggaagcggcaccgactttaccctgaccatcagcagcgtggagtccgaggacttcgccgtgtattactgcagccagaccagccacatcccttacaccttcggcggcggcaccaagctggagatcaaa

SEQ ID NO: 1486 - DNA, 735 bp, Artificial Sequence
  Synthetic polynucleotide
caggtgcagctggtgcagagcggcgccgagctgaagaaacctggcgccagcgtcaaggtgagctgcaaggcttccggaaacaccctcaccaactacgtgatccactgggtgaggcaggcccccggacagagactggagtggatgggctacattctgccctacaacgacctgaccaagtacagccagaagttccagggcagggtcaccatcaccagggacaagagcgccagcaccgcctacatggagctgagcagcctgaggtccgaggacacagccgtgtactactgcaccaggtgggactgggacggattcttcgacccttggggccaaggcaccacagtgacagtgagctccggcggaggcggcagcggcggcggaggaagcggcggcggcggaagcgacatcgtgatgacccagagccctctgagcctgcccgtgacactgggacagcctgccacactgtcctgcaggagcacccagagcctggtgcatagcaacggcaacacccacctgcactggttccagcagagacctggccagagccccctgagactgatctacagcgtgagcaacagggacagcggcgtgcccgatagatttagcggcagcggcagcggcaccgactttaccctgaaaatctccagggtggaggccgaggatgtgggcgtgtattactgctcccagacaagccacattccctatacattcggcggcggcaccaagctggagatcaag

SEQ ID NO: 1487 - DNA, 735 bp, Artificial Sequence
  Synthetic polynucleotide
gaaatcgtgatgacccagagccctgccacactgagcgtgagccctggcgagagagccagcatcagctgcagggcctcccagagcctggtgcactccaacggcaatacccacctgcactggtatcagcagagacccggccaggcccctaggctgctgatctactccgtgagcaacaggttctccgaggtgcccgccagattcagcggatccggcagcggcaccgacttcaccctcaccatctccagcgtggagagcgaggacttcgccgtctactactgcagccagacaagccacatcccctacaccttcggcggcggcaccaagctggagatcaagggcggcggcggcagcggcggcggaggcagcggaggcggcggatcccaggtgcaactggtgcagagcggagccgagctgaagaagcccggagccagcgtgaaggtcagctgcaaggccagcggcaacaccctgacaaactacgtgatccactgggtgaggcaggcccctggccaaaggctcgagtggatgggctacatcctcccctacaacgacctgaccaagtactcccagaagttccagggcagggtgaccatcaccagggataagagcgccagcaccgcctacatggaactcagcagcctgaggagcgaggacaccgccgtgtactactgcaccaggtgggactgggatggcttcttcgacccttggggccagggcaccaccgtgacagtgagctcc

SEQ ID NO: 1488 - DNA, 735 bp, Artificial Sequence
  Synthetic polynucleotide
gacatcgtgatgacacaatcccccctcagcctgcctgtgacactgggccagcctgccaccctgagctgcaggagcacccagtccctggtgcactccaacggcaacacccacctgcactggttccagcagaggcctggacagagccccctgaggctgatctacagcgtgagcaacagggactccggcgtgcccgatagattcagcggcagcggctccggcaccgatttcaccctgaagatctccagagtggaagccgaggacgtgggcgtctactactgcagccagaccagccatatcccctacaccttcggcggcggcaccaagctggagatcaagggaggcggcggaagcggcggaggcggatccggaggcggaggctcccaagtgcagctggtgcagagcggcgctgagctgaagaagcccggagccagcgtgaaggtgagctgcaaggccagcggaaacaccctgaccaactacgtgatccactgggtgagacaggcccccggacagagactcgagtggatgggctacatcctgccctacaacgacctgaccaagtacagccagaagttccagggcagggtgacaatcaccagggacaagagcgccagcaccgcctacatggagctgagcagcctgagatccgaggacaccgccgtgtactactgcaccaggtgggactgggacggcttctttgacccctggggccagggaaccacagtgaccgtgtcctcc

SEQ ID NO: 1489 - DNA, 711 bp, Artificial Sequence
  Synthetic polynucleotide
gaggtgcagctgcagcagagcggccctgagctggtgaagcccggcgccagcgtgaagatcagctgcaagacctccggctatacctttaccgagtacaccatcaactgggtgaagcagagccacggcaagagcctggagtggatcggcgatatctaccccgacaactacaacatcaggtacaaccagaagttcaagggcaaggccaccctgaccgtggacaagtccagcagcaccgcctacatggagctgaggagcctgtccagcgaggactccgccatctactactgcgccaaccacgactttttcgtcttctggggacagggcaccctggtgacagtgtccgctggcggcggcggcagcggcggcggcggctccggaggcggcggcagcgacatccagatgacacaggccacaagctccctgtccgccagcctgggcgatagggtgaccatcaattgcaggacctcccaggacatcagcaaccacctgaactggtaccagcagaaacccgacggcaccgtgaagctgctcatctactacaccagcaggctgcagtccggcgtccctagcagattcagcggatccggcagcggcaccgactatagcctgaccatcagcaacctcgagcaggaggacatcggcacctacttctgccatcagggcaacaccctgccccctacctttggcggcggcacaaagctggagattaag

SEQ ID NO: 1490 - DNA, 711 bp, Artificial Sequence
  Synthetic polynucleotide
gatatccagatgacccaggccaccagcagcctgagcgcttccctcggcgacagggtgaccatcaactgcaggaccagccaggacatctccaaccacctgaactggtaccagcagaagcccgacggcaccgtgaaactgctgatctactacaccagcagactgcagagcggcgtgccctccagattttccggcagcggctccggcaccgactacagcctgaccattagcaacctggagcaggaggacatcggaacctacttctgccaccagggcaacacactgcctcccaccttcggcggcggcacaaagctcgagatcaagggcggcggcggaagcggcggcggcggcagcggcggcggaggctccgaggtgcaactgcaacagagcggacctgagctggtgaagcctggcgccagcgtgaagatctcctgtaagaccagcggctacaccttcaccgagtacaccatcaactgggtgaagcagagccacggcaagagcctcgaatggatcggcgacatctatcccgacaactacaatatcagatacaaccagaagttcaagggaaaggccaccctgaccgtggataagtcctcctccaccgcttacatggagctgaggagcctgagcagcgaggactccgccatctactactgcgccaaccacgacttcttcgtgttctggggccaaggcaccctcgtgaccgtgagcgcc

SEQ ID NO: 1491 - DNA, 711 bp, Artificial Sequence
  Synthetic polynucleotide
caggtgcagctggtgcagtccggcgctgagctgaagaagcccggcgccagcgtgaagatcagctgcaaggccagcggctacaccttcaccgaatacaccatcaactgggtgagacaggcccctggacagaggctcgagtggatgggcgacatctaccccgacaactacagcatcaggtacaaccagaagttccagggcagggtgacaatcaccagggacaccagcgccagcaccgcctatatggagctgagcagcctgagatccgaggacaccgccgtctattactgcgccaaccacgacttcttcgtgttctggggccagggaacactggtgaccgtgtccagcggcggcggcggcagcggcggcggaggaagcggcggcggcggcagcgatatccagatgacccagagcccctcctccctgagcgctagcgtgggcgacagggtgaccattacctgtcaggcctcccaggacatcagcaactacctgaactggtaccagcagaagcctggcaaggcccccaagctgctgatctattacaccagcaggctggagaccggcgtgccctccagattcagcggctccggctccggaaccgacttcaccttcaccatcagctccctgcagcctgaggacatcgccacctactactgccagcagggcaacaccctgcctcccacattcggcggcggcacaaaggtggagatcaaa

SEQ ID NO: 1492 - DNA, 711 bp, Artificial Sequence
  Synthetic polynucleotide
caggtgcagctggtccagtccggcgccgaactgaagaagcctggcgccagcgtgaagatcagctgcaaggcctccggctacaccttcaccgagtacaccatcaactgggtgaggcaagcccccggccagagactggagtggatgggcgacatctaccccgacaactacagcatcaggtacaaccagaagttccagggcagggtgacaatcaccagggataccagcgccagcacagcctatatggagctgtcctccctgagatccgaggacaccgccgtgtattactgcgccaaccacgacttcttcgtgttctggggccaaggcaccctggtgaccgtgagcagcggcggcggcggctccggcggcggaggctccggaggcggaggcagcgacatccagatgacccagagcccttccagcctgagcgctagcctgggcgacagggtgaccatcacctgcaggaccagccaggacatcagcaatcacctgaactggtaccagcaaaagcccggcaaggcccctaagctgctgatctactacaccagcaggctggaaagcggcgtgcctagcaggttcagcggcagcggctccggaaccgactacagcctgaccattagcagcctgcaacctgaggacatcggcacctattactgccagcagggcaacaccctgcctcctacctttggcggcggcaccaaactcgagatcaag

SEQ ID NO: 1493 - DNA, 711 bp, Artificial Sequence
  Synthetic polynucleotide
caggtgcagctggtgcagagcggccctgagctgaagaagcccggagccagcgtgaagatctcctgcaagacctccggctacaccttcaccgagtacaccatcaactgggtgaagcaggcccccggacagggactggaatggatcggcgacatctaccccgacaactacaacatcaggtacaaccagaagttccaaggcaaggccaccatcacaagggacaccagcagcagcaccgcctacatggagctgagcagcctgaggagcgaggataccgccgtgtactactgcgccaaccacgacttcttcgtgttctggggccagggcaccctggtgacagtgagcagcggaggaggcggaagcggaggaggaggatccggaggaggaggcagcgacatccagatgacccagtccccctcctccctgagcgcctccgtgggagacagggtgaccatcacctgccaggccagccaggacatcagcaactacctgaactggtaccagcagaagcccggcaaggcccccaagctgctgatttactacaccagcaggctggaaaccggcgtgcccagcagatttagcggcagcggcagcggcaccgactttacctttaccatctccagcctgcagcccgaggatatcgccacatactactgccagcagggcaacaccctcccccctacctttggcggcggcaccaaggtggagattaag

SEQ ID NO: 1494 - DNA, 711 bp, Artificial Sequence
  Synthetic polynucleotide
caggtgcagctggtgcagtccggccccgaactgaaaaagcccggcgccagcgtcaagatcagctgcaagacctccggctacaccttcaccgagtacaccatcaactgggtgaagcaggcccccggccagggactggaatggattggcgacatctaccccgacaactacaacattaggtataaccagaagttccagggcaaggccaccatcacaagagacaccagcagcagcaccgcctacatggagctgagcagcctgaggagcgaggacaccgccgtgtactactgcgccaaccacgacttcttcgtgttctggggccagggaaccctggtgacagtgtccagcggcggcggcggctccggcggcggcggctccggcggcggcggcagcgacattcagatgacacagagcccctccagcctgagcgccagcctgggcgatagggtgaccatcacctgcagaaccagccaggacatcagcaaccacctgaattggtaccagcagaagcccggaaaggcccccaaactgctgatctactacaccagcaggctggagagcggcgtgcctagcaggtttagcggcagcggcagcggcacagattacagcctgaccatcagcagcctgcagcccgaagacatcggcacctactactgccagcagggcaacaccctgccccctacctttggcggaggcaccaagctggagatcaag

SEQ ID NO: 1495 - DNA, 711 bp, Artificial Sequence
  Synthetic polynucleotide
gacatccagatgacacagagccctagcagcctgagcgcttccgtgggcgacagggtgaccatcacctgccaggccagccaggacatcagcaactacctcaactggtaccagcagaagcccggcaaggcccctaagctgctgatctactacacctccaggctggagaccggagtgccctccagattttccggcagcggcagcggcaccgatttcaccttcaccatcagcagcctgcagcccgaggacatcgccacctactattgccagcagggcaacaccctgccccccacatttggaggcggcaccaaggtggagatcaagggcggaggaggaagcggaggaggaggaagcggaggaggcggaagccaggtgcagctggtgcagagcggcgctgagctcaagaagcctggcgccagcgtgaagatcagctgcaaagcctccggatacaccttcaccgagtacaccatcaattgggtgagacaggcccccggccaaagactggagtggatgggcgacatctatcccgacaactacagcatcaggtacaaccagaagttccagggcagggtgacaatcaccagagacaccagcgccagcaccgcctacatggagctgagcagcctgaggagcgaggacaccgccgtgtactactgcgccaatcacgacttcttcgtgttctggggccagggaaccctggtgaccgtcagctcc

SEQ ID NO: 1496 - DNA, 711 bp, Artificial Sequence
  Synthetic polynucleotide
gatatccagatgacacagagccctagctccctgagcgccagcctgggcgatagggtgaccatcacctgcaggacctcccaggacatcagcaaccacctgaactggtaccagcagaagcccggcaaagcccccaagctgctgatctactacaccagcaggctggaaagcggcgtgcccagcaggtttagcggaagcggcagcggcaccgactacagcctgaccatcagctccctgcagcccgaggacatcggcacctactactgccagcagggcaacaccctgcctcccaccttcggaggcggaaccaagctggagattaagggaggcggcggaagcggcggcggcggctccggcggaggaggcagccaggtgcagctggtgcagtccggagccgagctgaaaaagcctggcgccagcgtgaagatcagctgcaaggccagcggctacaccttcaccgagtacaccatcaactgggtgaggcaggcccctggccagagactcgagtggatgggcgacatctaccccgacaactactccatcaggtacaaccagaagtttcagggcagggtgaccattaccagggacaccagcgccagcacagcctacatggagctgagcagcctgaggagcgaggatacagccgtctactactgcgccaaccacgactttttcgtgttctggggacagggcaccctggtgaccgtgtcctcc

SEQ ID NO: 1497 - DNA, 711 bp, Artificial Sequence
  Synthetic polynucleotide
gacatccaaatgacccagagccctagctccctgagcgcttccgtgggcgacagagtgaccattacctgccaggccagccaggacatcagcaactacctgaactggtatcagcagaagcctggcaaggcccccaagctgctgatctactacaccagcaggctggagaccggagtgcccagcaggtttagcggctccggatccggcaccgacttcaccttcaccatctccagcctgcagcccgaggacatcgccacctactactgccagcagggcaataccctcccccctaccttcggaggcggcaccaaggtggagatcaagggcggcggcggctccggcggcggcggcagcggcggaggcggcagccaggtgcaactggtgcagagcggccctgagctgaagaaacccggcgccagcgtgaaaatcagctgcaagaccagcggctacacattcaccgagtacaccatcaactgggtgaagcaggctcccggacagggactggagtggatcggcgacatctaccctgacaactacaacatcagatacaaccaaaagttccagggcaaggccaccatcaccagggacaccagctcctccaccgcctacatggagctgagcagcctgaggagcgaggacaccgctgtgtactactgcgccaaccacgacttcttcgtgttctggggccagggaaccctggtgaccgtgagcagc

SEQ ID NO: 1498 - DNA, 711 bp, Artificial Sequence
  Synthetic polynucleotide
gatatccagatgacacaaagccccagcagcctgtccgctagcctgggcgatagggtgaccatcacatgcaggaccagccaggacatctccaaccacctgaactggtaccagcagaagcctggaaaggcccccaaactgctgatctactacaccagcaggctggagagcggcgtgcctagcaggttttccggcagcggcagcggcaccgactatagcctgaccatcagctccctgcagcccgaggacatcggcacctactactgccagcagggaaacacactgccccccacctttggcggcggcacaaagctggagatcaagggcggcggcggatccggcggcggaggcagcggaggaggaggaagccaggtgcagctggtgcagtccggccctgagctgaagaagcccggagccagcgtgaaaattagctgcaagacctccggctacacattcaccgagtacaccatcaactgggtgaagcaggctcccggccagggactggagtggatcggcgacatctaccccgacaactacaacatcaggtacaaccagaaattccagggcaaggccaccatcaccagggacaccagctcctccaccgcctatatggagctgtccagcctgagaagcgaggataccgccgtgtactactgcgccaaccacgatttcttcgtgttctggggccagggcacactggtcaccgtgagcagc

SEQ ID NO: 1499 - protein, 245 aa, Artificial Sequence
  Synthetic polypeptide
DIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKGGGGSGGGGSGGGGSGQVQLVQSGAEVKKPGASVKVSCKASGYTFTNYGMNWVRQAPGQGLKWMGWINTYTGEPTYADAFKGRVTMTRDTSISTAYMELSRLRSDDTAVYYCARDYGDYGMDYWGQGTTVTVSS

SEQ ID NO: 1500 - protein, 245 aa, Artificial Sequence
  Synthetic polypeptide
QVQLVQSGAEVKKPGASVKVSCKASGYTFTNYGMNWVRQAPGQGLKWMGWINTYTGEPTYADAFKGRVTMTRDTSISTAYMELSRLRSDDTAVYYCARDYGDYGMDYWGQGTTVTVSSGGGGSGGGGSGGGGSGDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIK

SEQ ID NO: 1501 - protein, 243 aa, Artificial Sequence
  Synthetic polypeptide
QVQLQQSGGGLVQPGGSLKLSCAASGIDFSRYWMSWVRRAPGKGLEWIGEINPDSSTINYAPSLKDKFIISRDNAKNTLYLQMSKVRSEDTALYYCASLYYDYGDAMDYWGQGTSVTVSSGGGGSGGGGSGGGGSGDIVMTQSQRFMTTSVGDRVSVTCKASQSVDSNVAWYQQKPRQSPKALIFSASLRFSGVPARFTGSGSGTDFTLTISNLQSEDLAEYFCQQYNNYPLTFGAGTKLELK

SEQ ID NO: 1502 - protein, 243 aa, Artificial Sequence
  Synthetic polypeptide
DIVMTQSQRFMTTSVGDRVSVTCKASQSVDSNVAWYQQKPRQSPKALIFSASLRFSGVPARFTGSGSGTDFTLTISNLQSEDLAEYFCQQYNNYPLTFGAGTKLELKGGGGSGGGGSGGGGSGQVQLQQSGGGLVQPGGSLKLSCAASGIDFSRYWMSWVRRAPGKGLEWIGEINPDSSTINYAPSLKDKFIISRDNAKNTLYLQMSKVRSEDTALYYCASLYYDYGDAMDYWGQGTSVTVSS

SEQ ID NO: 1503 - protein, 242 aa, Artificial Sequence
  Synthetic polypeptide
EVQLVESGGGLVQPGGSLKLSCAASGIDFSRYWMSWVRQAPGKGLEWIGEINPDSSTINYADSVKGRFTISRDNAKNTLYLQMNLSRAEDTALYYCASLYYDYGDAMDYWGQGTLVTVSSGGGGSGGGGSGGGGSDIQMTQSPSSLSASVGDRVTITCRASQSVDSNVAWYQQKPEKAPKSLIFSASLRFSGVPSRFSGSGSGTDFTLTISSLQPEDFATYYCQQYNSYPLTFGAGTKLEIK

SEQ ID NO: 1504 - protein, 242 aa, Artificial Sequence
  Synthetic polypeptide
EVQLVESGGGLVQPGGSLKLSCAASGIDFSRYWMSWVRQAPGKGLEWIGEINPDSSTINYADSVKGRFTISRDNAKNTLYLQMNLSRAEDTALYYCASLYYDYGDAMDYWGQGTLVTVSSGGGGSGGGGSGGGGSDIQMTQSPSSLSASPGDRVSVTCKASQSVDSNVAWYQQKPRQAPKALIFSASLRFSGVPARFTGSGSGTDFTLTISNLQSEDFATYYCQQYNNYPLTFGAGTKLEIK

SEQ ID NO: 1505 - protein, 242 aa, Artificial Sequence
  Synthetic polypeptide
DIQMTQSPSSLSASVGDRVTITCRASQSVDSNVAWYQQKPEKAPKSLIFSASLRFSGVPSRFSGSGSGTDFTLTISSLQPEDFATYYCQQYNSYPLTFGAGTKLEIKGGGGSGGGGSGGGGSEVQLVESGGGLVQPGGSLKLSCAASGIDFSRYWMSWVRQAPGKGLEWIGEINPDSSTINYADSVKGRFTISRDNAKNTLYLQMNLSRAEDTALYYCASLYYDYGDAMDYWGQGTLVTVSS

SEQ ID NO: 1506 - protein, 242 aa, Artificial Sequence
  Synthetic polypeptide
DIQMTQSPSSLSASPGDRVSVTCKASQSVDSNVAWYQQKPRQAPKALIFSASLRFSGVPARFTGSGSGTDFTLTISNLQSEDFATYYCQQYNNYPLTFGAGTKLEIKGGGGSGGGGSGGGGSEVQLVESGGGLVQPGGSLKLSCAASGIDFSRYWMSWVRQAPGKGLEWIGEINPDSSTINYADSVKGRFTISRDNAKNTLYLQMNLSRAEDTALYYCASLYYDYGDAMDYWGQGTLVTVSS

SEQ ID NO: 1507 - protein, 245 aa, Artificial Sequence
  Synthetic polypeptide
EVQLQQSGPELVKPGASVKMSCKASGNTLTNYVIHWMKQMPGQGLDWIGYILPYNDLTKYNEKFTGKATLTSDKSSSSAYMELNSLTSEDSAVYYCTRWDWDGFFDPWGQGTTLTVSSGGGGSGGGGSGGGGSDIVMTQSPLSLPVSLGDQASISCRSTQSLVHSNGNTHLHWYLQRPGQSPKLLIYSVSNRFSEVPDRFSASGSGTDFTLKISRVEAEDLGVYFCSQTSHIPYTFGGGTKLEIK

SEQ ID NO: 1508 - protein, 245 aa, Artificial Sequence
  Synthetic polypeptide
DIVMTQSPLSLPVSLGDQASISCRSTQSLVHSNGNTHLHWYLQRPGQSPKLLIYSVSNRFSEVPDRFSASGSGTDFTLKISRVEAEDLGVYFCSQTSHIPYTFGGGTKLEIKGGGGSGGGGSGGGGSEVQLQQSGPELVKPGASVKMSCKASGNTLTNYVIHWMKQMPGQGLDWIGYILPYNDLTKYNEKFTGKATLTSDKSSSSAYMELNSLTSEDSAVYYCTRWDWDGFFDPWGQGTTLTVSS

SEQ ID NO: 1509 - protein, 245 aa, Artificial Sequence
  Synthetic polypeptide
QVQLVQSGAELKKPGASVKVSCKASGNTLTNYVIHWVRQAPGQRLEWMGYILPYNDLTKYSQKFQGRVTITRDKSASTAYMELSSLRSEDTAVYYCTRWDWDGFFDPWGQGTTVTVSSGGGGSGGGGSGGGGSEIVMTQSPATLSVSPGERASISCRASQSLVHSNGNTHLHWYQQRPGQAPRLLIYSVSNRFSEVPARFSGSGSGTDFTLTISSVESEDFAVYYCSQTSHIPYTFGGGTKLEIK

SEQ ID NO: 1510 - protein, 245 aa, Artificial Sequence
  Synthetic polypeptide
QVQLVQSGAELKKPGASVKVSCKASGNTLTNYVIHWVRQAPGQRLEWMGYILPYNDLTKYSQKFQGRVTITRDKSASTAYMELSSLRSEDTAVYYCTRWDWDGFFDPWGQGTTVTVSSGGGGSGGGGSGGGGSDIVMTQSPLSLPVTLGQPATLSCRSTQSLVHSNGNTHLHWFQQRPGQSPLRLIYSVSNRDSGVPDRFSGSGSGTDFTLKISRVEAEDVGVYYCSQTSHIPYTFGGGTKLEIK

SEQ ID NO: 1511 - protein, 245 aa, Artificial Sequence
  Synthetic polypeptide
EIVMTQSPATLSVSPGERASISCRASQSLVHSNGNTHLHWYQQRPGQAPRLLIYSVSNRFSEVPARFSGSGSGTDFTLTISSVESEDFAVYYCSQTSHIPYTFGGGTKLEIKGGGGSGGGGSGGGGSQVQLVQSGAELKKPGASVKVSCKASGNTLTNYVIHWVRQAPGQRLEWMGYILPYNDLTKYSQKFQGRVTITRDKSASTAYMELSSLRSEDTAVYYCTRWDWDGFFDPWGQGTTVTVSS

SEQ ID NO: 1512 - protein, 245 aa, Artificial Sequence
  Synthetic polypeptide
DIVMTQSPLSLPVTLGQPATLSCRSTQSLVHSNGNTHLHWFQQRPGQSPLRLIYSVSNRDSGVPDRFSGSGSGTDFTLKISRVEAEDVGVYYCSQTSHIPYTFGGGTKLEIKGGGGSGGGGSGGGGSQVQLVQSGAELKKPGASVKVSCKASGNTLTNYVIHWVRQAPGQRLEWMGYILPYNDLTKYSQKFQGRVTITRDKSASTAYMELSSLRSEDTAVYYCTRWDWDGFFDPWGQGTTVTVSS

SEQ ID NO: 1513 - protein, 237 aa, Artificial Sequence
  Synthetic polypeptide
EVQLQQSGPELVKPGASVKISCKTSGYTFTEYTINWVKQSHGKSLEWIGDIYPDNYNIRYNQKFKGKATLTVDKSSSTAYMELRSLSSEDSAIYYCANHDFFVFWGQGTLVTVSAGGGGSGGGGSGGGGSDIQMTQATSSLSASLGDRVTINCRTSQDISNHLNWYQQKPDGTVKLLIYYTSRLQSGVPSRFSGSGSGTDYSLTISNLEQEDIGTYFCHQGNTLPPTFGGGTKLEIK

SEQ ID NO: 1514 - protein, 237 aa, Artificial Sequence
  Synthetic polypeptide
DIQMTQATSSLSASLGDRVTINCRTSQDISNHLNWYQQKPDGTVKLLIYYTSRLQSGVPSRFSGSGSGTDYSLTISNLEQEDIGTYFCHQGNTLPPTFGGGTKLEIKGGGGSGGGGSGGGGSEVQLQQSGPELVKPGASVKISCKTSGYTFTEYTINWVKQSHGKSLEWIGDIYPDNYNIRYNQKFKGKATLTVDKSSSTAYMELRSLSSEDSAIYYCANHDFFVFWGQGTLVTVSA

SEQ ID NO: 1515 - protein, 237 aa, Artificial Sequence
  Synthetic polypeptide
QVQLVQSGAELKKPGASVKISCKASGYTFTEYTINWVRQAPGQRLEWMGDIYPDNYSIRYNQKFQGRVTITRDTSASTAYMELSSLRSEDTAVYYCANHDFFVFWGQGTLVTVSSGGGGSGGGGSGGGGSDIQMTQSPSSLSASVGDRVTITCQASQDISNYLNWYQQKPGKAPKLLIYYTSRLETGVPSRFSGSGSGTDFTFTISSLQPEDIATYYCQQGNTLPPTFGGGTKVEIK

SEQ ID NO: 1516 - protein, 237 aa, Artificial Sequence
  Synthetic polypeptide
QVQLVQSGAELKKPGASVKISCKASGYTFTEYTINWVRQAPGQRLEWMGDIYPDNYSIRYNQKFQGRVTITRDTSASTAYMELSSLRSEDTAVYYCANHDFFVFWGQGTLVTVSSGGGGSGGGGSGGGGSDIQMTQSPSSLSASLGDRVTITCRTSQDISNHLNWYQQKPGKAPKLLIYYTSRLESGVPSRFSGSGSGTDYSLTISSLQPEDIGTYYCQQGNTLPPTFGGGTKLEIK

SEQ ID NO: 1517 - protein, 237 aa, Artificial Sequence
  Synthetic polypeptide
QVQLVQSGPELKKPGASVKISCKTSGYTFTEYTINWVKQAPGQGLEWIGDIYPDNYNIRYNQKFQGKATITRDTSSSTAYMELSSLRSEDTAVYYCANHDFFVFWGQGTLVTVSSGGGGSGGGGSGGGGSDIQMTQSPSSLSASVGDRVTITCQASQDISNYLNWYQQKPGKAPKLLIYYTSRLETGVPSRFSGSGSGTDFTFTISSLQPEDIATYYCQQGNTLPPTFGGGTKVEIK

SEQ ID NO: 1518 - protein, 237 aa, Artificial Sequence
  Synthetic polypeptide
QVQLVQSGPELKKPGASVKISCKTSGYTFTEYTINWVKQAPGQGLEWIGDIYPDNYNIRYNQKFQGKATITRDTSSSTAYMELSSLRSEDTAVYYCANHDFFVFWGQGTLVTVSSGGGGSGGGGSGGGGSDIQMTQSPSSLSASLGDRVTITCRTSQDISNHLNWYQQKPGKAPKLLIYYTSRLESGVPSRFSGSGSGTDYSLTISSLQPEDIGTYYCQQGNTLPPTFGGGTKLEIK

SEQ ID NO: 1519 - protein, 237 aa, Artificial Sequence
  Synthetic polypeptide
DIQMTQSPSSLSASVGDRVTITCQASQDISNYLNWYQQKPGKAPKLLIYYTSRLETGVPSRFSGSGSGTDFTFTISSLQPEDIATYYCQQGNTLPPTFGGGTKVEIKGGGGSGGGGSGGGGSQVQLVQSGAELKKPGASVKISCKASGYTFTEYTINWVRQAPGQRLEWMGDIYPDNYSIRYNQKFQGRVTITRDTSASTAYMELSSLRSEDTAVYYCANHDFFVFWGQGTLVTVSS

SEQ ID NO: 1520 - protein, 237 aa, Artificial Sequence
  Synthetic polypeptide
DIQMTQSPSSLSASLGDRVTITCRTSQDISNHLNWYQQKPGKAPKLLIYYTSRLESGVPSRFSGSGSGTDYSLTISSLQPEDIGTYYCQQGNTLPPTFGGGTKLEIKGGGGSGGGGSGGGGSQVQLVQSGAELKKPGASVKISCKASGYTFTEYTINWVRQAPGQRLEWMGDIYPDNYSIRYNQKFQGRVTITRDTSASTAYMELSSLRSEDTAVYYCANHDFFVFWGQGTLVTVSS

SEQ ID NO: 1521 - protein, 237 aa, Artificial Sequence
  Synthetic polypeptide
DIQMTQSPSSLSASVGDRVTITCQASQDISNYLNWYQQKPGKAPKLLIYYTSRLETGVPSRFSGSGSGTDFTFTISSLQPEDIATYYCQQGNTLPPTFGGGTKVEIKGGGGSGGGGSGGGGSQVQLVQSGPELKKPGASVKISCKTSGYTFTEYTINWVKQAPGQGLEWIGDIYPDNYNIRYNQKFQGKATITRDTSSSTAYMELSSLRSEDTAVYYCANHDFFVFWGQGTLVTVSS

SEQ ID NO: 1522 - protein, 237 aa, Artificial Sequence
  Synthetic polypeptide
DIQMTQSPSSLSASLGDRVTITCRTSQDISNHLNWYQQKPGKAPKLLIYYTSRLESGVPSRFSGSGSGTDYSLTISSLQPEDIGTYYCQQGNTLPPTFGGGTKLEIKGGGGSGGGGSGGGGSQVQLVQSGPELKKPGASVKISCKTSGYTFTEYTINWVKQAPGQGLEWIGDIYPDNYNIRYNQKFQGKATITRDTSSSTAYMELSSLRSEDTAVYYCANHDFFVFWGQGTLVTVSS

SEQ ID NO: 1523 - protein, 120 aa, Artificial Sequence
  Synthetic polypeptide
QVQLQQSGGGLVQPGGSLKLSCAASGIDFSRYWMSWVRRAPGKGLEWIGEINPDSSTINYAPSLKDKFIISRDNAKNTLYLQMSKVRSEDTALYYCASLYYDYGDAMDYWGQGTSVTVSS

SEQ ID NO: 1524 - protein, 120 aa, Artificial Sequence
  Synthetic polypeptide
EVQLVESGGGLVQPGGSLKLSCAASGIDFSRYWMSWVRQAPGKGLEWIGEINPDSSTINYADSVKGRFTISRDNAKNTLYLQMNLSRAEDTALYYCASLYYDYGDAMDYWGQGTLVTVSS

SEQ ID NO: 1525 - protein, 107 aa, Artificial Sequence
  Synthetic polypeptide
DIVMTQSQRFMTTSVGDRVSVTCKASQSVDSNVAWYQQKPRQSPKALIFSASLRFSGVPARFTGSGSGTDFTLTISNLQSEDLAEYFCQQYNNYPLTFGAGTKLELK

SEQ ID NO: 1526 - protein, 107 aa, Artificial Sequence
  Synthetic polypeptide
DIQMTQSPSSLSASVGDRVTITCRASQSVDSNVAWYQQKPEKAPKSLIFSASLRFSGVPSRFSGSGSGTDFTLTISSLQPEDFATYYCQQYNSYPLTFGAGTKLEIK

SEQ ID NO: 1527 - protein, 107 aa, Artificial Sequence
  Synthetic polypeptide
DIQMTQSPSSLSASPGDRVSVTCKASQSVDSNVAWYQQKPRQAPKALIFSASLRFSGVPARFTGSGSGTDFTLTISNLQSEDFATYYCQQYNNYPLTFGAGTKLEIK

SEQ ID NO: 1528 - protein, 118 aa, Artificial Sequence
  Synthetic polypeptide
EVQLQQSGPELVKPGASVKMSCKASGNTLTNYVIHWMKQMPGQGLDWIGYILPYNDLTKYNEKFTGKATLTSDKSSSSAYMELNSLTSEDSAVYYCTRWDWDGFFDPWGQGTTLTVSS

SEQ ID NO: 1529 - protein, 112 aa, Artificial Sequence
  Synthetic polypeptide
DIVMTQSPLSLPVSLGDQASISCRSTQSLVHSNGNTHLHWYLQRPGQSPKLLIYSVSNRFSEVPDRFSASGSGTDFTLKISRVEAEDLGVYFCSQTSHIPYTFGGGTKLEIK

SEQ ID NO: 1530 - protein, 115 aa, Artificial Sequence
  Synthetic polypeptide
EVQLQQSGPELVKPGASVKISCKTSGYTFTEYTINWVKQSHGKSLEWIGDIYPDNYNIRYNQKFKGKATLTVDKSSSTAYMELRSLSSEDSAIYYCANHDFFVFWGQGTLVTVSA

SEQ ID NO: 1531 - protein, 107 aa, Artificial Sequence
  Synthetic polypeptide
DIQMTQATSSLSASLGDRVTINCRTSQDISNHLNWYQQKPDGTVKLLIYYTSRLQSGVPSRFSGSGSGTDYSLTISNLEQEDIGTYFCHQGNTLPPTFGGGTKLEIK

SEQ ID NO: 1532 - DNA, 7035 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtccagttggtgcaaagcggggcggaggtgaaaaaacccggcgcttccgtgaaggtgtcctgtaaggcgtccggttatacgttcacgaactacgggatgaattgggttcgccaagcgccggggcagggactgaaatggatggggtggataaatacctacaccggcgaacctacatacgccgacgcttttaaagggcgagtcactatgacgcgcgataccagcatatccaccgcatacatggagctgtcccgactccggtcagacgacacggctgtctactattgtgctcgggactatggcgattatggcatggactactggggtcagggtacgactgtaacagttagtagtggtggaggcggcagtggcggggggggaagcggaggagggggttctggtgacatagttatgacccaatccccagatagtttggcggtttctctgggcgagagggcaacgattaattgtcgcgcatcaaagagcgtttcaacgagcggatattcttttatgcattggtaccagcaaaaacccggacaaccgccgaagctgctgatctacttggcttcaaatcttgagtctggggtgccggaccgattttctggtagtggaagcggaactgactttacgctcacgatcagttcactgcaggctgaggatgtagcggtctattattgccagcacagtagagaagtcccctggaccttcggtcaaggcacgaaagtagaaattaaaagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgcaaacggggcagaaagaaactcctgtatatattcaaacaaccatttatgagaccagtacaaactactcaagaggaagatggctgtagctgccgatttccagaagaagaagaaggaggatgtgaactgcgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 1533 - DNA, 7020 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggaggtccagctggtggagagcggcggaggactggtccagcctggcggctccctgaaactgagctgcgccgccagcggcatcgacttcagcaggtactggatgagctgggtgagacaggcccctggcaagggcctggaatggatcggcgagatcaaccccgactccagcaccatcaactacgccgacagcgtcaagggcaggttcaccattagcagggacaatgccaagaacaccctgtacctgcagatgaacctgagcagggccgaagacaccgccctgtactactgtgccagcctgtactacgactatggcgacgctatggactactggggccagggcaccctggtgacagtgagctccggaggaggcggcagcggcggaggcggcagcggcggaggcggcagcgacatccagatgacccagagccctagcagcctgagcgcctccgtgggagatagggtgacaatcacctgtagggccagccagagcgtggactccaacgtggcctggtatcaacagaagcccgagaaggcccccaagagcctgatcttttccgcctccctgaggttcagcggagtccccagcaggttctccggatccggctccggaaccgactttaccctgaccatctccagcctgcagcccgaggacttcgccacctactactgccagcagtacaacagctaccccctgaccttcggcgccggcacaaagctggagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 1534 - DNA, 7020 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggaggtgcagctggtggagagcggaggaggactggtgcagcccggaggctccctgaagctgagctgcgctgcctccggcatcgacttcagcaggtactggatgagctgggtgaggcaggctcccggcaaaggcctggagtggatcggcgagatcaaccccgacagcagcaccatcaactacgccgacagcgtgaagggcaggttcaccatcagcagggacaacgccaagaataccctgtacctgcagatgaacctgagcagggccgaggacacagccctgtactactgtgccagcctgtactacgactatggagacgctatggactactggggccagggaaccctggtgaccgtgagcagcggaggcggaggctccggcggcggaggcagcggaggaggcggcagcgatatccagatgacccagtcccccagctccctgagcgctagccctggcgacagggtgagcgtgacatgcaaggccagccagagcgtggacagcaacgtggcctggtaccagcagaaacccagacaggcccccaaggccctgatcttcagcgccagcctgaggtttagcggcgtgcccgctaggtttaccggatccggcagcggcaccgacttcaccctgaccatctccaacctgcagtccgaggacttcgccacctactactgccagcagtacaacaactaccccctgacattcggcgccggaaccaagctggagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 1535 - DNA, 7020 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggacatccagatgacccagagccctagcagcctgagcgctagcgtgggcgacagggtgaccatcacctgcagggccagccagagcgtggactccaacgtggcctggtaccagcagaagcccgagaaggcccccaagagcctgatcttcagcgccagcctgaggttctccggagtgcctagcagatttagcggcagcggcagcggcacagacttcaccctgaccatcagcagcctccagcccgaggatttcgccacctactactgccagcagtacaactcctaccccctgaccttcggcgccggcacaaagctggagatcaagggaggaggaggaagcggaggaggaggaagcggaggcggaggaagcgaggtgcagctggtggagtccggaggaggcctggtgcaacctggaggcagcctgaagctgagctgtgccgccagcggaatcgacttcagcaggtactggatgtcctgggtgagacaggcccctggcaagggcctggagtggatcggagagatcaaccccgacagctccaccatcaactacgccgacagcgtgaagggcaggttcaccatcagcagagacaacgccaagaacaccctgtacctgcagatgaacctgtccagagccgaggacaccgccctgtactactgcgccagcctgtattacgactacggcgacgctatggactactggggccagggcaccctggtgacagtgagcagcagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 1536 - DNA, 7020 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggacatccaaatgacccagtcccctagcagcctgtccgccagccctggagacagggtgtccgtgacctgcaaggccagccagtccgtggacagcaacgtcgcctggtatcagcagaagcccaggcaagctcccaaggctctgatcttctccgccagcctgagattttccggcgtgcccgccagattcaccggaagcggcagcggcaccgacttcaccctgaccatcagcaacctgcagagcgaggatttcgccacatactactgccagcagtacaacaactaccccctgaccttcggagccggcaccaagctggagatcaaaggcggcggaggcagcggcggcggcggcagcggcggaggcggatccgaagtgcagctggtggaaagcggaggcggactcgtgcagcctggcggaagcctgaagctgagctgtgccgccagcggcatcgacttcagcaggtactggatgagctgggtgaggcaggctcccggcaaaggcctggagtggatcggcgagatcaaccctgacagcagcaccatcaactacgccgacagcgtgaaaggcaggttcaccatcagcagggacaacgccaagaacaccctgtacctgcagatgaacctgtccagagccgaggacaccgccctgtactactgcgccagcctgtactacgactacggcgacgctatggactactggggccaaggcaccctcgtgaccgtcagctccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 1537 - DNA, 7029 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggaggtgcagctgcagcagtccggccctgagctcgtgaagcctggagccagcgtgaaaatgagctgtaaggcctccggcaacaccctcaccaactacgtgatccattggatgaagcagatgcccggccagggcctggactggattggctacattctgccctacaacgacctgaccaagtacaacgagaagttcaccggcaaggccaccctgaccagcgataagagctccagcagcgcctacatggagctgaactccctgaccagcgaggacagcgccgtgtactactgcaccaggtgggactgggatggcttcttcgacccctggggacagggcaccaccctgacagtgtccagcggaggaggcggcagcggcggcggcggctccggcggcggcggcagcgatatcgtgatgacacagtcccctctgagcctgcctgtgagcctgggcgaccaggccagcatcagctgcaggtccacccagtccctggtgcactccaacggcaacacccacctgcactggtacctgcaaaggcccggccagtcccctaagctgctgatctacagcgtgagcaacaggtttagcgaggtgcccgatagattttccgccagcggcagcggcaccgacttcacactgaagatctccagggtggaggccgaggatctgggcgtgtacttctgcagccagaccagccacatcccctacaccttcggcggcggaaccaagctggagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 1538 - DNA, 7029 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggacatcgtgatgacccagagccccctgagcctgcctgtgtccctgggagaccaggcttccatcagctgcaggtccacccagagcctggtgcactccaacggcaacacccacctgcactggtacctgcagaggcctggccagtcccccaagctgctgatctacagcgtgagcaataggttcagcgaggtgcccgacagattcagcgccagcggaagcggcaccgacttcaccctgaagatcagcagggtcgaggccgaagatctgggcgtgtacttctgctcccagacatcccacatcccttacaccttcggcggcggcaccaagctggagattaagggcggcggaggatccggcggaggaggatccggaggaggaggaagcgaggtgcagctgcagcagagcggacccgagctggtgaaacccggagccagcgtcaaaatgagctgcaaggccagcggcaacaccctgaccaactacgtcatccactggatgaagcagatgcccggacagggcctggactggatcggctacatcctgccctacaacgacctgaccaagtacaacgagaaattcaccggcaaggccaccctgaccagcgacaagagcagcagcagcgcctacatggagctgaacagcctgaccagcgaggactccgccgtgtactattgcaccaggtgggactgggacggcttctttgacccctggggccagggcacaacactcaccgtgagctccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 1539 - DNA, 7029 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtgcagctggtgcagagcggagccgagctcaagaagcccggagcctccgtgaaggtgagctgcaaggccagcggcaacaccctgaccaactacgtgatccactgggtgagacaagcccccggccaaaggctggagtggatgggctacatcctgccctacaacgacctgaccaagtacagccagaagttccagggcagggtgaccatcaccagggataagagcgcctccaccgcctatatggagctgagcagcctgaggagcgaggacaccgctgtgtactactgtacaaggtgggactgggacggcttctttgacccctggggccagggcacaacagtgaccgtcagcagcggcggcggaggcagcggcggcggcggcagcggcggaggcggaagcgaaatcgtgatgacccagagccccgccacactgagcgtgagccctggcgagagggccagcatctcctgcagggctagccaaagcctggtgcacagcaacggcaacacccacctgcactggtaccagcagagacccggacaggctcccaggctgctgatctacagcgtgagcaacaggttctccgaggtgcctgccaggtttagcggcagcggaagcggcaccgactttaccctgaccatcagcagcgtggagtccgaggacttcgccgtgtattactgcagccagaccagccacatcccttacaccttcggcggcggcaccaagctggagatcaaaagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 1540 - DNA, 7035 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtgcagctggtgcagagcggagccgagctcaagaagcccggagcctccgtgaaggtgagctgcaaggccagcggcaacaccctgaccaactacgtgatccactgggtgagacaagcccccggccaaaggctggagtggatgggctacatcctgccctacaacgacctgaccaagtacagccagaagttccagggcagggtgaccatcaccagggataagagcgcctccaccgcctatatggagctgagcagcctgaggagcgaggacaccgctgtgtactactgtacaaggtgggactgggacggcttctttgacccctggggccagggcacaacagtgaccgtcagcagcggcggcggaggcagcggcggcggcggcagcggcggaggcggaagcgaaatcgtgatgacccagagccccgccacactgagcgtgagccctggcgagagggccagcatctcctgcagggctagccaaagcctggtgcacagcaacggcaacacccacctgcactggtaccagcagagacccggacaggctcccaggctgctgatctacagcgtgagcaacaggttctccgaggtgcctgccaggtttagcggcagcggaagcggcaccgactttaccctgaccatcagcagcgtggagtccgaggacttcgccgtgtattactgcagccagaccagccacatcccttacaccttcggcggcggcaccaagctggagatcaaaagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgcaaacggggcagaaagaaactcctgtatatattcaaacaaccatttatgagaccagtacaaactactcaagaggaagatggctgtagctgccgatttccagaagaagaagaaggaggatgtgaactgcgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 1541 - DNA, 7029 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtgcagctggtgcagagcggcgccgagctgaagaaacctggcgccagcgtcaaggtgagctgcaaggcttccggaaacaccctcaccaactacgtgatccactgggtgaggcaggcccccggacagagactggagtggatgggctacattctgccctacaacgacctgaccaagtacagccagaagttccagggcagggtcaccatcaccagggacaagagcgccagcaccgcctacatggagctgagcagcctgaggtccgaggacacagccgtgtactactgcaccaggtgggactgggacggattcttcgacccttggggccaaggcaccacagtgacagtgagctccggcggaggcggcagcggcggcggaggaagcggcggcggcggaagcgacatcgtgatgacccagagccctctgagcctgcccgtgacactgggacagcctgccacactgtcctgcaggagcacccagagcctggtgcatagcaacggcaacacccacctgcactggttccagcagagacctggccagagccccctgagactgatctacagcgtgagcaacagggacagcggcgtgcccgatagatttagcggcagcggcagcggcaccgactttaccctgaaaatctccagggtggaggccgaggatgtgggcgtgtattactgctcccagacaagccacattccctatacattcggcggcggcaccaagctggagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 1542 - DNA, 7029 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggaaatcgtgatgacccagagccctgccacactgagcgtgagccctggcgagagagccagcatcagctgcagggcctcccagagcctggtgcactccaacggcaatacccacctgcactggtatcagcagagacccggccaggcccctaggctgctgatctactccgtgagcaacaggttctccgaggtgcccgccagattcagcggatccggcagcggcaccgacttcaccctcaccatctccagcgtggagagcgaggacttcgccgtctactactgcagccagacaagccacatcccctacaccttcggcggcggcaccaagctggagatcaagggcggcggcggcagcggcggcggaggcagcggaggcggcggatcccaggtgcaactggtgcagagcggagccgagctgaagaagcccggagccagcgtgaaggtcagctgcaaggccagcggcaacaccctgacaaactacgtgatccactgggtgaggcaggcccctggccaaaggctcgagtggatgggctacatcctcccctacaacgacctgaccaagtactcccagaagttccagggcagggtgaccatcaccagggataagagcgccagcaccgcctacatggaactcagcagcctgaggagcgaggacaccgccgtgtactactgcaccaggtgggactgggatggcttcttcgacccttggggccagggcaccaccgtgacagtgagctccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 1543 - DNA, 7029 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggacatcgtgatgacacaatcccccctcagcctgcctgtgacactgggccagcctgccaccctgagctgcaggagcacccagtccctggtgcactccaacggcaacacccacctgcactggttccagcagaggcctggacagagccccctgaggctgatctacagcgtgagcaacagggactccggcgtgcccgatagattcagcggcagcggctccggcaccgatttcaccctgaagatctccagagtggaagccgaggacgtgggcgtctactactgcagccagaccagccatatcccctacaccttcggcggcggcaccaagctggagatcaagggaggcggcggaagcggcggaggcggatccggaggcggaggctcccaagtgcagctggtgcagagcggcgctgagctgaagaagcccggagccagcgtgaaggtgagctgcaaggccagcggaaacaccctgaccaactacgtgatccactgggtgagacaggcccccggacagagactcgagtggatgggctacatcctgccctacaacgacctgaccaagtacagccagaagttccagggcagggtgacaatcaccagggacaagagcgccagcaccgcctacatggagctgagcagcctgagatccgaggacaccgccgtgtactactgcaccaggtgggactgggacggcttctttgacccctggggccagggaaccacagtgaccgtgtcctccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 1544 - DNA, 7005 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggaggtgcagctgcagcagagcggccctgagctggtgaagcccggcgccagcgtgaagatcagctgcaagacctccggctatacctttaccgagtacaccatcaactgggtgaagcagagccacggcaagagcctggagtggatcggcgatatctaccccgacaactacaacatcaggtacaaccagaagttcaagggcaaggccaccctgaccgtggacaagtccagcagcaccgcctacatggagctgaggagcctgtccagcgaggactccgccatctactactgcgccaaccacgactttttcgtcttctggggacagggcaccctggtgacagtgtccgctggcggcggcggcagcggcggcggcggctccggaggcggcggcagcgacatccagatgacacaggccacaagctccctgtccgccagcctgggcgatagggtgaccatcaattgcaggacctcccaggacatcagcaaccacctgaactggtaccagcagaaacccgacggcaccgtgaagctgctcatctactacaccagcaggctgcagtccggcgtccctagcagattcagcggatccggcagcggcaccgactatagcctgaccatcagcaacctcgagcaggaggacatcggcacctacttctgccatcagggcaacaccctgccccctacctttggcggcggcacaaagctggagattaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 1545 - DNA, 7005 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggatatccagatgacccaggccaccagcagcctgagcgcttccctcggcgacagggtgaccatcaactgcaggaccagccaggacatctccaaccacctgaactggtaccagcagaagcccgacggcaccgtgaaactgctgatctactacaccagcagactgcagagcggcgtgccctccagattttccggcagcggctccggcaccgactacagcctgaccattagcaacctggagcaggaggacatcggaacctacttctgccaccagggcaacacactgcctcccaccttcggcggcggcacaaagctcgagatcaagggcggcggcggaagcggcggcggcggcagcggcggcggaggctccgaggtgcaactgcaacagagcggacctgagctggtgaagcctggcgccagcgtgaagatctcctgtaagaccagcggctacaccttcaccgagtacaccatcaactgggtgaagcagagccacggcaagagcctcgaatggatcggcgacatctatcccgacaactacaatatcagatacaaccagaagttcaagggaaaggccaccctgaccgtggataagtcctcctccaccgcttacatggagctgaggagcctgagcagcgaggactccgccatctactactgcgccaaccacgacttcttcgtgttctggggccaaggcaccctcgtgaccgtgagcgccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 1546 - DNA, 7005 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtgcagctggtgcagtccggcgctgagctgaagaagcccggcgccagcgtgaagatcagctgcaaggccagcggctacaccttcaccgaatacaccatcaactgggtgagacaggcccctggacagaggctcgagtggatgggcgacatctaccccgacaactacagcatcaggtacaaccagaagttccagggcagggtgacaatcaccagggacaccagcgccagcaccgcctatatggagctgagcagcctgagatccgaggacaccgccgtctattactgcgccaaccacgacttcttcgtgttctggggccagggaacactggtgaccgtgtccagcggcggcggcggcagcggcggcggaggaagcggcggcggcggcagcgatatccagatgacccagagcccctcctccctgagcgctagcgtgggcgacagggtgaccattacctgtcaggcctcccaggacatcagcaactacctgaactggtaccagcagaagcctggcaaggcccccaagctgctgatctattacaccagcaggctggagaccggcgtgccctccagattcagcggctccggctccggaaccgacttcaccttcaccatcagctccctgcagcctgaggacatcgccacctactactgccagcagggcaacaccctgcctcccacattcggcggcggcacaaaggtggagatcaaaagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 1547 - DNA, 7005 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtgcagctggtccagtccggcgccgaactgaagaagcctggcgccagcgtgaagatcagctgcaaggcctccggctacaccttcaccgagtacaccatcaactgggtgaggcaagcccccggccagagactggagtggatgggcgacatctaccccgacaactacagcatcaggtacaaccagaagttccagggcagggtgacaatcaccagggataccagcgccagcacagcctatatggagctgtcctccctgagatccgaggacaccgccgtgtattactgcgccaaccacgacttcttcgtgttctggggccaaggcaccctggtgaccgtgagcagcggcggcggcggctccggcggcggaggctccggaggcggaggcagcgacatccagatgacccagagcccttccagcctgagcgctagcctgggcgacagggtgaccatcacctgcaggaccagccaggacatcagcaatcacctgaactggtaccagcaaaagcccggcaaggcccctaagctgctgatctactacaccagcaggctggaaagcggcgtgcctagcaggttcagcggcagcggctccggaaccgactacagcctgaccattagcagcctgcaacctgaggacatcggcacctattactgccagcagggcaacaccctgcctcctacctttggcggcggcaccaaactcgagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 1548 - DNA, 7005 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtgcagctggtgcagagcggccctgagctgaagaagcccggagccagcgtgaagatctcctgcaagacctccggctacaccttcaccgagtacaccatcaactgggtgaagcaggcccccggacagggactggaatggatcggcgacatctaccccgacaactacaacatcaggtacaaccagaagttccaaggcaaggccaccatcacaagggacaccagcagcagcaccgcctacatggagctgagcagcctgaggagcgaggataccgccgtgtactactgcgccaaccacgacttcttcgtgttctggggccagggcaccctggtgacagtgagcagcggaggaggcggaagcggaggaggaggatccggaggaggaggcagcgacatccagatgacccagtccccctcctccctgagcgcctccgtgggagacagggtgaccatcacctgccaggccagccaggacatcagcaactacctgaactggtaccagcagaagcccggcaaggcccccaagctgctgatttactacaccagcaggctggaaaccggcgtgcccagcagatttagcggcagcggcagcggcaccgactttacctttaccatctccagcctgcagcccgaggatatcgccacatactactgccagcagggcaacaccctcccccctacctttggcggcggcaccaaggtggagattaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 1549 - DNA, 7005 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccgcaggtgcagctggtgcagtccggccccgaactgaaaaagcccggcgccagcgtcaagatcagctgcaagacctccggctacaccttcaccgagtacaccatcaactgggtgaagcaggcccccggccagggactggaatggattggcgacatctaccccgacaactacaacattaggtataaccagaagttccagggcaaggccaccatcacaagagacaccagcagcagcaccgcctacatggagctgagcagcctgaggagcgaggacaccgccgtgtactactgcgccaaccacgacttcttcgtgttctggggccagggaaccctggtgacagtgtccagcggcggcggcggctccggcggcggcggctccggcggcggcggcagcgacattcagatgacacagagcccctccagcctgagcgccagcctgggcgatagggtgaccatcacctgcagaaccagccaggacatcagcaaccacctgaattggtaccagcagaagcccggaaaggcccccaaactgctgatctactacaccagcaggctggagagcggcgtgcctagcaggtttagcggcagcggcagcggcacagattacagcctgaccatcagcagcctgcagcccgaagacatcggcacctactactgccagcagggcaacaccctgccccctacctttggcggaggcaccaagctggagatcaagagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 1550 - DNA, 7005 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggacatccagatgacacagagccctagcagcctgagcgcttccgtgggcgacagggtgaccatcacctgccaggccagccaggacatcagcaactacctcaactggtaccagcagaagcccggcaaggcccctaagctgctgatctactacacctccaggctggagaccggagtgccctccagattttccggcagcggcagcggcaccgatttcaccttcaccatcagcagcctgcagcccgaggacatcgccacctactattgccagcagggcaacaccctgccccccacatttggaggcggcaccaaggtggagatcaagggcggaggaggaagcggaggaggaggaagcggaggaggcggaagccaggtgcagctggtgcagagcggcgctgagctcaagaagcctggcgccagcgtgaagatcagctgcaaagcctccggatacaccttcaccgagtacaccatcaattgggtgagacaggcccccggccaaagactggagtggatgggcgacatctatcccgacaactacagcatcaggtacaaccagaagttccagggcagggtgacaatcaccagagacaccagcgccagcaccgcctacatggagctgagcagcctgaggagcgaggacaccgccgtgtactactgcgccaatcacgacttcttcgtgttctggggccagggaaccctggtgaccgtcagctccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 1551 - DNA, 7005 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggatatccagatgacacagagccctagctccctgagcgccagcctgggcgatagggtgaccatcacctgcaggacctcccaggacatcagcaaccacctgaactggtaccagcagaagcccggcaaagcccccaagctgctgatctactacaccagcaggctggaaagcggcgtgcccagcaggtttagcggaagcggcagcggcaccgactacagcctgaccatcagctccctgcagcccgaggacatcggcacctactactgccagcagggcaacaccctgcctcccaccttcggaggcggaaccaagctggagattaagggaggcggcggaagcggcggcggcggctccggcggaggaggcagccaggtgcagctggtgcagtccggagccgagctgaaaaagcctggcgccagcgtgaagatcagctgcaaggccagcggctacaccttcaccgagtacaccatcaactgggtgaggcaggcccctggccagagactcgagtggatgggcgacatctaccccgacaactactccatcaggtacaaccagaagtttcagggcagggtgaccattaccagggacaccagcgccagcacagcctacatggagctgagcagcctgaggagcgaggatacagccgtctactactgcgccaaccacgactttttcgtgttctggggacagggcaccctggtgaccgtgtcctccagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 1552 - DNA, 7005 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggacatccaaatgacccagagccctagctccctgagcgcttccgtgggcgacagagtgaccattacctgccaggccagccaggacatcagcaactacctgaactggtatcagcagaagcctggcaaggcccccaagctgctgatctactacaccagcaggctggagaccggagtgcccagcaggtttagcggctccggatccggcaccgacttcaccttcaccatctccagcctgcagcccgaggacatcgccacctactactgccagcagggcaataccctcccccctaccttcggaggcggcaccaaggtggagatcaagggcggcggcggctccggcggcggcggcagcggcggaggcggcagccaggtgcaactggtgcagagcggccctgagctgaagaaacccggcgccagcgtgaaaatcagctgcaagaccagcggctacacattcaccgagtacaccatcaactgggtgaagcaggctcccggacagggactggagtggatcggcgacatctaccctgacaactacaacatcagatacaaccaaaagttccagggcaaggccaccatcaccagggacaccagctcctccaccgcctacatggagctgagcagcctgaggagcgaggacaccgctgtgtactactgcgccaaccacgacttcttcgtgttctggggccagggaaccctggtgaccgtgagcagcagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 1553 - DNA, 7005 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatggcgcttccggtgacagcactgctcctccccttggcgctgttgctccacgcagcaaggccggatatccagatgacacaaagccccagcagcctgtccgctagcctgggcgatagggtgaccatcacatgcaggaccagccaggacatctccaaccacctgaactggtaccagcagaagcctggaaaggcccccaaactgctgatctactacaccagcaggctggagagcggcgtgcctagcaggttttccggcagcggcagcggcaccgactatagcctgaccatcagctccctgcagcccgaggacatcggcacctactactgccagcagggaaacacactgccccccacctttggcggcggcacaaagctggagatcaagggcggcggcggatccggcggcggaggcagcggaggaggaggaagccaggtgcagctggtgcagtccggccctgagctgaagaagcccggagccagcgtgaaaattagctgcaagacctccggctacacattcaccgagtacaccatcaactgggtgaagcaggctcccggccagggactggagtggatcggcgacatctaccccgacaactacaacatcaggtacaaccagaaattccagggcaaggccaccatcaccagggacaccagctcctccaccgcctatatggagctgtccagcctgagaagcgaggataccgccgtgtactactgcgccaaccacgatttcttcgtgttctggggccagggcacactggtcaccgtgagcagcagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 1554 - DNA, 21 bp, Artificial Sequence
  Synthetic polynucleotide
agaaggataagatggcggagg

SEQ ID NO: 1555 - DNA, 20 bp, Artificial Sequence
  Synthetic polynucleotide
gctttctggcgtccttagaa

SEQ ID NO: 1556 - DNA, 24 bp, Artificial Sequence
  Synthetic polynucleotide
tctaccctctcatggcctagaagg

SEQ ID NO: 1557 - DNA, 23 bp, Artificial Sequence
  Synthetic polynucleotide
tggagtgattaggaacatgagct

SEQ ID NO: 1558 - DNA, 26 bp, Artificial Sequence
  Synthetic polynucleotide
aagctcaagcacttctagttagaaac

SEQ ID NO: 1559 - DNA, 22 bp, Artificial Sequence
  Synthetic polynucleotide
attccaccccaccttcactaag

SEQ ID NO: 1560 - DNA, 79 bp, Artificial Sequence
  Synthetic polynucleotide
cgtggccttagctgtgctcgcgctactctctctttctgcctggaggctatccagcgtgagtctctcctaccctcccgct

SEQ ID NO: 1561 - DNA, 78 bp, Artificial Sequence
  Synthetic polynucleotide
cgtggccttagctgtgctcgcgctactctctctttcgcctggaggctatccagcgtgagtctctcctaccctcccgct

SEQ ID NO: 1562 - DNA, 75 bp, Artificial Sequence
  Synthetic polynucleotide
cgtggccttagctgtgctcgcgctactctctctttctggaggctatccagcgtgagtctctcctaccctcccgct

SEQ ID NO: 1563 - DNA, 84 bp, Artificial Sequence
  Synthetic polynucleotide
cgtggccttagctgtgctcgcgctactctctctttctggatagcctggaggctatccagcgtgagtctctcctaccctcccgct

SEQ ID NO: 1564 - DNA, 55 bp, Artificial Sequence
  Synthetic polynucleotide
cgtggccttagctgtgctcgcgctatccagcgtgagtctctcctaccctcccgct

SEQ ID NO: 1565 - DNA, 82 bp, Artificial Sequence
  Synthetic polynucleotide
cgtggccttagctgtgctcgcgctactctctctttctgtggcctggaggctatccagcgtgagtctctcctaccctcccgct

SEQ ID NO: 1566 - DNA, 19 bp, Artificial Sequence
  Synthetic polynucleotide
aagagcaacaaatctgact

SEQ ID NO: 1567 - DNA, 39 bp, Artificial Sequence
  Synthetic polynucleotide
aagagcaacagtgctgtgcctggagcaacaaatctgact

SEQ ID NO: 1568 - DNA, 33 bp, Artificial Sequence
  Synthetic polynucleotide
aagagcaacagtgctggagcaacaaatctgact

SEQ ID NO: 1569 - DNA, 34 bp, Artificial Sequence
  Synthetic polynucleotide
aagagcaacagtgcctggagcaacaaatctgact

SEQ ID NO: 1570 - DNA, 19 bp, Artificial Sequence
  Synthetic polynucleotide
aagagcaacagtgctgact

SEQ ID NO: 1571 - DNA, 41 bp, Artificial Sequence
  Synthetic polynucleotide
aagagcaacagtgctgtgggcctggagcaacaaatctgact

SEQ ID NO: 1572 - DNA, 38 bp, Artificial Sequence
  Synthetic polynucleotide
aagagcaacagtgctggcctggagcaacaaatctgact

SEQ ID NO: 1573 - DNA, 41 bp, Artificial Sequence
  Synthetic polynucleotide
aagagcaacagtgctgtgtgcctggagcaacaaatctgact

SEQ ID NO: 1574 - RNA, 100 nt, Artificial Sequence
  Synthetic polynucleotide
  misc_feature (1)..(4): Modified by 2'-O'methyl phosphorothioate linkage
  misc_feature (97)..(100): Modified by 2'-O'methyl phosphorothioate linkage
cugcagcuucuccaacacauguuuuagagcuagaaauagcaaguuaaaauaaggcuaguccguuaucaacuugaaaaaguggcaccgagucggugcuuuu

SEQ ID NO: 1575 - RNA, 100 nt, Artificial Sequence; identical to SEQ ID NO: 1574
  Synthetic polynucleotide

SEQ ID NO: 1576 - DNA, 130 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcct

SEQ ID NO: 1577 - DNA, 141 bp, Artificial Sequence
  Synthetic polynucleotide
aggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1578 - DNA, 800 bp, Artificial Sequence
  Synthetic polynucleotide
tgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatc

SEQ ID NO: 1579 - DNA, 820 bp, Artificial Sequence
  Synthetic polynucleotide
tgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcc

SEQ ID NO: 1580 - DNA, 804 bp, Artificial Sequence; identical to SEQ ID NO: 1326
  Synthetic polynucleotide

SEQ ID NO: 1581 - DNA, 841 bp, Artificial Sequence
  Synthetic polynucleotide
tgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgactattcaccgattttgattctc

SEQ ID NO: 1582 - DNA, 925 bp, Artificial Sequence
  Synthetic polynucleotide
attcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaagg

SEQ ID NO: 1583 - DNA, 4682 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatcggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatgcttcttttggttacgtctctgttgctttgcgaacttcctcatccagcgttcttgctgatccccgatattcagatgactcagaccaccagtagcttgtctgcctcactgggagaccgagtaacaatctcctgcagggcaagtcaagacattagcaaatacctcaattggtaccagcagaagcccgacggaacggtaaaactcctcatctatcatacgtcaaggttgcattccggagtaccgtcacgattttcaggttctgggagcggaactgactattccttgactatttcaaacctcgagcaggaggacattgcgacatatttttgtcaacaaggtaataccctcccttacactttcggaggaggaaccaaactcgaaattaccgggtccaccagtggctctgggaagcctggcagtggagaaggttccactaaaggcgaggtgaagctccaggagagcggccccggtctcgttgcccccagtcaaagcctctctgtaacgtgcacagtgagtggtgtatcattgcctgattatggcgtctcctggataaggcagcccccgcgaaagggtcttgaatggcttggggtaatatggggctcagagacaacgtattataactccgctctcaaaagtcgcttgacgataataaaagataactccaagagtcaagttttccttaaaatgaacagtttgcagactgacgataccgctatatattattgtgctaaacattattactacggcggtagttacgcgatggattattgggggcaggggacttctgtcacagtcagtagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgtggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1584 - DNA, 4803 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgccggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatgcttcttttggttacgtctctgttgctttgcgaacttcctcatccagcgttcttgctgatccccgatattcagatgactcagaccaccagtagcttgtctgcctcactgggagaccgagtaacaatctcctgcagggcaagtcaagacattagcaaatacctcaattggtaccagcagaagcccgacggaacggtaaaactcctcatctatcatacgtcaaggttgcattccggagtaccgtcacgattttcaggttctgggagcggaactgactattccttgactatttcaaacctcgagcaggaggacattgcgacatatttttgtcaacaaggtaataccctcccttacactttcggaggaggaaccaaactcgaaattaccgggtccaccagtggctctgggaagcctggcagtggagaaggttccactaaaggcgaggtgaagctccaggagagcggccccggtctcgttgcccccagtcaaagcctctctgtaacgtgcacagtgagtggtgtatcattgcctgattatggcgtctcctggataaggcagcccccgcgaaagggtcttgaatggcttggggtaatatggggctcagagacaacgtattataactccgctctcaaaagtcgcttgacgataataaaagataactccaagagtcaagttttccttaaaatgaacagtttgcagactgacgataccgctatatattattgtgctaaacattattactacggcggtagttacgcgatggattattgggggcaggggacttctgtcacagtcagtagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1585 - DNA, 4844 bp, Artificial Sequence
  Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgactattcaccgattttgattctcggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaccaccatgcttcttttggttacgtctctgttgctttgcgaacttcctcatccagcgttcttgctgatccccgatattcagatgactcagaccaccagtagcttgtctgcctcactgggagaccgagtaacaatctcctgcagggcaagtcaagacattagcaaatacctcaattggtaccagcagaagcccgacggaacggtaaaactcctcatctatcatacgtcaaggttgcattccggagtaccgtcacgattttcaggttctgggagcggaactgactattccttgactatttcaaacctcgagcaggaggacattgcgacatatttttgtcaacaaggtaataccctcccttacactttcggaggaggaaccaaactcgaaattaccgggtccaccagtggctctgggaagcctggcagtggagaaggttccactaaaggcgaggtgaagctccaggagagcggccccggtctcgttgcccccagtcaaagcctctctgtaacgtgcacagtgagtggtgtatcattgcctgattatggcgtctcctggataaggcagcccccgcgaaagggtcttgaatggcttggggtaatatggggctcagagacaacgtattataactccgctctcaaaagtcgcttgacgataataaaagataactccaagagtcaagttttccttaaaatgaacagtttgcagactgacgataccgctatatattattgtgctaaacattattactacggcggtagttacgcgatggattattgggggcaggggacttctgtcacagtcagtagtgctgctgcctttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgctcaaagcggagtaggttgttgcattccgattacatgaatatgactcctcgccggcctgggccgacaagaaaacattaccaaccctatgcccccccacgagacttcgctgcgtacaggtcccgagtgaagttttcccgaagcgcagacgctccggcatatcagcaaggacagaatcagctgtataacgaactgaatttgggacgccgcgaggagtatgacgtgcttgataaacgccgggggagagacccggaaatggggggtaaaccccgaagaaagaatccccaagaaggactctacaatgaactccagaaggataagatggcggaggcctactcagaaataggtatgaagggcgaacgacgacggggaaaaggtcacgatggcctctaccaagggttgagtacggcaaccaaagatacgtacgatgcactgcatatgcaggccctgcctcccagataataataaaatcgctatccatcgaagatggatgtgtgttggttttttgtgtgattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggtaaccacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1586 - protein, 21 aa, Artificial Sequence
  Synthetic polypeptide
MALPVTALLLPLALLLHAARP

SEQ ID NO: 1587 - RNA, 100 nt, Artificial Sequence
  Synthetic polynucleotide
  misc_feature (1)..(4): Modified by 2'-O'methyl phosphorothioate linkage
  misc_feature (97)..(100): Modified by 2'-O'methyl phosphorothioate linkage
gagaaucaaaaucggugaauguuuuagagcuagaaauagcaaguuaaaauaaggcuaguccguuaucaacuugaaaaaguggcaccgagucggugcuuuu

SEQ ID NO: 1588 - RNA, 100 nt, Artificial Sequence; identical to SEQ ID NO: 1587
  Synthetic polynucleotide

SEQ ID NO: 1589 - protein, 118 aa, Artificial Sequence
  Synthetic polypeptide
QVQLVQSGAELKKPGASVKVSCKASGNTLTNYVIHWVRQAPGQRLEWMGYILPYNDLTKYSQKFQGRVTITRDKSASTAYMELSSLRSEDTAVYYCTRWDWDGFFDPWGQGTTVTVSS

SEQ ID NO: 1590 - protein, 112 aa, Artificial Sequence
  Synthetic polypeptide
EIVMTQSPATLSVSPGERASISCRASQSLVHSNGNTHLHWYQQRPGQAPRLLIYSVSNRFSEVPARFSGSGSGTDFTLTISSVESEDFAVYYCSQTSHIPYTFGGGTKLEIK

SEQ ID NO: 1591 - protein, 15 aa, Artificial Sequence
  Synthetic polypeptide
GGGGSGGGGSGGGGS

SEQ ID NO: 1592 - protein, 118 aa, Artificial Sequence
  Synthetic polypeptide
QVQLVQSGAEVKKPGASVKVSCKASGYTFTNYGMNWVRQAPGQGLKWMGWINTYTGEPTYADAFKGRVTMTRDTSISTAYMELSRLRSDDTAVYYCARDYGDYGMDYWGQGTTVTVSS

SEQ ID NO: 1593 - protein, 111 aa, Artificial Sequence
  Synthetic polypeptide
DIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIK

SEQ ID NO: 1594 - protein, 16 aa, Artificial Sequence
  Synthetic polypeptide
GGGGSGGGGSGGGGSG

SEQ ID NO: 1595 - protein, 120 aa, Artificial Sequence
  Synthetic polypeptide
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 1596 - protein, 107 aa, Artificial Sequence
  Synthetic polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEIT

SEQ ID NO: 1597 - protein, 18 aa, Artificial Sequence
  Synthetic polypeptide
GSTSGSGKPGSGEGSTKG

SEQ ID NO: 1598 - protein, 22 aa, Artificial Sequence
  Synthetic polypeptide
MLLLVTSLLLCELPHPAFLLIP

SEQ ID NO: 1599 - DNA, 252 bp, Artificial Sequence
  Synthetic polynucleotide
tttgtcccggtatttctcccagccaaaccgaccacgactcccgccccgcgccctccgacacccgctcccaccatcgcctctcaacctcttagtcttcgccccgaggcatgccgacccgccgccgggggtgctgttcatacgaggggcttggacttcgcttgtgatatttacatttgggctccgttggcgggtacgtgcggcgtccttttgttgtcactcgttattactttgtattgtaatcacaggaatcgc

SEQ ID NO: 1600 - protein, 84 aa, Artificial Sequence
  Synthetic polypeptide
FVPVFLPAKPTTTPAPRPPTPAPTIASQPLSLRPEACRPAAGGAVHTRGLDFACDIYIWAPLAGTCGVLLLSLVITLYCNHRNR

SEQ ID NO: 1601 - protein, 40 aa, Artificial Sequence
  Synthetic polypeptide
SKRSRLLHSDYMNMTPRRPGPTRKHYQPYAPPRDFAAYRS

SEQ ID NO: 1602 - protein, 112 aa, Artificial Sequence
  Synthetic polypeptide
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

What is claimed is:

1. A population of cells comprising engineered human T cells, wherein the engineered human T cells comprise:
   (a) a disrupted T cell receptor alpha chain constant region (TRAC) gene comprising a deletion of the nucleotide sequence of SEQ ID NO: 76;
   (b) a nucleic acid comprising a nucleotide sequence encoding a chimeric antigen receptor (CAR) comprising (i) an ectodomain that comprises an anti-BCMA single-chain variable fragment (scFv), wherein the anti-BCMA scFv comprises a variable heavy chain comprising the amino acid sequence of SEQ ID NO: 1524, 1530, or 1589, and a variable light chain comprising the amino acid sequence of SEQ ID NO: 1526, 1527, 1531, or 1590, (ii) a CD8 transmembrane domain, and (iii) an endodomain that comprises a CD28 or 41BB co-stimulatory domain and a CD3z co-stimulatory domain, and wherein the nucleic acid is inserted in the disrupted TRAC gene; and
   (c) a disrupted beta-2-microglobulin (B2M) gene.

2. The population of cells of claim 1, wherein the anti-BCMA scFv comprises:
   (i) a variable heavy chain comprising the amino acid sequence of SEQ ID NO: 1524 and a variable light chain comprising the amino acid sequence of SEQ ID NO: 1526;
   (ii) a variable heavy chain comprising the amino acid sequence of SEQ ID NO: 1524 and a variable light chain comprising the amino acid sequence of SEQ ID NO: 1527;

(iii) a variable heavy chain comprising the amino acid sequence of SEQ ID NO: 1530 and a variable light chain comprising the amino acid sequence of SEQ ID NO: 1531; and (iv) a variable heavy chain comprising the amino acid sequence of SEQ ID NO: 1589 and a variable light chain comprising the amino acid sequence of SEQ ID NO: 1590.

3. The population of cells of claim 2, wherein the anti-BCMA scFv comprises a variable heavy chain comprising the amino acid sequence of SEQ ID NO: 1589 and a variable light chain comprising the amino acid sequence of SEQ ID NO: 1590.

4. The population of cells of claim 3, wherein the CAR comprises an endodomain comprising a 41BB co-stimulatory domain and a CD3z co-stimulatory domain.

5. The population of cells of claim 1, wherein (i) at least 70% of the engineered human T cells do not express a detectable level of TCR surface protein; (ii) at least 50% of the engineered human T cells do not express a detectable level of B2M surface protein; and/or (iii) at least 50% of the engineered human T cells express a detectable level of the CAR.

6. The population of cells of claim 1, wherein (i) co-culture of the engineered human T cells with BCMA+ B cells results in lysis of at least 50% of the BCMA+ cells; (ii) the engineered human T cells produce interferon gamma in the presence of BCMA+ cells; and/or (iii) the engineered human T cells do not proliferate in the absence of cytokine stimulation, growth factor stimulation, or antigen stimulation.

7. The population of cells of claim 1, wherein the disrupted B2M gene comprises an insertion of at least one nucleotide base pair and/or a deletion of at least one nucleotide base pair.

8. The population of cells of claim 7, wherein the disrupted B2M gene comprises a nucleotide sequence selected from the group consisting of: SEQ ID NO: 1560; SEQ ID NO: 1561; SEQ ID NO: 1562; SEQ ID NO: 1563; SEQ ID NO: 1564; and SEQ ID NO: 1565.

9. A composition comprising the population of cells of claim 1, and a pharmaceutically acceptable carrier.

10. A population of cells comprising engineered human T cells, wherein the engineered human T cells comprise:
(a) a disrupted TRAC gene comprising a deletion of the nucleotide sequence of SEQ ID NO: 76;
(b) a nucleic acid comprising a nucleotide sequence encoding a CAR comprising (i) an ectodomain that comprises an anti-BCMA scFv, wherein the anti-BCMA scFv comprises the amino acid sequence of SEQ ID NO: 1503, 1504, 1505, 1506, 1509, 1511, 1513, or 1514, (ii) a CD8 transmembrane domain, and (iii) an endodomain that comprises a CD28 or 41BB co-stimulatory domain and a CD3z co-stimulatory domain, and wherein the nucleic acid is inserted in the disrupted TRAC gene; and
(c) a disrupted B2M gene.

11. The population of cells of claim 10, wherein the anti-BCMA scFv comprises the amino acid sequence of SEQ ID NO: 1509.

12. The population of cells of claim 11, wherein the CAR comprises an endodomain comprising a 41BB co-stimulatory domain and a CD3z co-stimulatory domain.

13. The population of cells of claim 10, wherein the anti-BCMA scFv is encoded by the nucleotide sequence of SEQ ID NO: 1479, 1480, 1481, 1482, 1485, 1487, 1489, or 1490.

14. The population of cells of claim 13, wherein the anti-BCMA scFv is encoded by the nucleotide sequence of SEQ ID NO: 1485.

15. The population of cells of claim 10, wherein (i) at least 70% of the engineered human T cells do not express a detectable level of TCR surface protein; (ii) at least 50% of the engineered human T cells do not express a detectable level of B2M surface protein; and/or (iii) at least 50% of the engineered human T cells express a detectable level of the CAR.

16. The population of cells of claim 10, wherein (i) co-culture of the engineered human T cells with BCMA+ B cells results in lysis of at least 50% of the BCMA+ B cells; (ii) the engineered human T cells produce interferon gamma in the presence of BCMA+ cells; and/or (iii) the engineered human T cells do not proliferate in the absence of cytokine stimulation, growth factor stimulation, or antigen stimulation.

17. The population of cells of claim 10, wherein the disrupted B2M gene comprises an insertion of at least one nucleotide base pair and/or a deletion of at least one nucleotide base pair.

18. The population of cells of claim 17, wherein the disrupted B2M gene comprises a nucleotide sequence selected from the group consisting of: SEQ ID NO: 1560; SEQ ID NO: 1561; SEQ ID NO: 1562; SEQ ID NO: 1563; SEQ ID NO: 1564; and SEQ ID NO: 1565.

19. A composition comprising the population of cells of claim 10, and a pharmaceutically acceptable carrier.

20. A population of cells comprising engineered human T cells, wherein the engineered human T cells comprise:
(a) a disrupted TRAC gene comprising a deletion of the nucleotide sequence of SEQ ID NO: 76;
(b) a nucleic acid comprising a nucleotide sequence encoding a CAR, wherein the CAR comprises the amino acid sequence of SEQ ID NO: 1453, 1454, 1455, 1456, 1457, 1460, 1461, 1463, 1465, or 1466, and wherein the nucleic acid is inserted in the disrupted TRAC gene; and
(c) a disrupted B2M gene.

21. The population of cells of claim 20, wherein the CAR comprises the amino acid sequence of SEQ ID NO: 1460.

22. The population of cells of claim 20, wherein the CAR comprises the amino acid sequence of SEQ ID NO: 1461.

23. The population of cells of claim 20, wherein the CAR is encoded by the nucleotide sequence of SEQ ID NO: 1427, 1428, 1429, 1430, 1431, 1434, 1435, 1437, 1439, or 1440.

24. The population of cells of claim 23, wherein the CAR is encoded by the nucleotide sequence of SEQ ID NO: 1435.

25. The population of cells of claim 20, wherein (i) at least 70% of the engineered human T cells do not express a detectable level of TCR surface protein; (ii) at least 50% of the engineered human T cells do not express a detectable level of B2M surface protein; and/or (iii) at least 50% of the engineered human T cells express a detectable level of the CAR.

26. The population of cells of claim 20, wherein (i) co-culture of the engineered human T cells with BCMA+ B cells results in lysis of at least 50% of the BCMA+ B cells; (ii) the engineered human T cells produce interferon gamma in the presence of BCMA+ cells; and/or (iii) the engineered human T cells do not proliferate in the absence of cytokine stimulation, growth factor stimulation, or antigen stimulation.

27. The population of cells of claim 20, wherein the disrupted B2M gene comprises an insertion of at least one nucleotide base pair and/or a deletion of at least one nucleotide base pair.

28. The population of cells of claim 27, wherein the disrupted B2M gene comprises a nucleotide sequence selected from the group consisting of: SEQ ID NO: 1560; SEQ ID NO: 1561; SEQ ID NO: 1562; SEQ ID NO: 1563; SEQ ID NO: 1564; and SEQ ID NO: 1565.

29. A composition comprising the population of cells of claim 20, and a pharmaceutically acceptable carrier.

* * * * *